United States Patent
Mann et al.

(10) Patent No.: US 8,741,556 B2
(45) Date of Patent: Jun. 3, 2014

(54) METHOD FOR QUANTIFYING BIOMOLECULES

(75) Inventors: Matthias Mann, Stockdorf (DE); Tamar Geiger, Tel Aviv (IL); Francesca Forner, Cartigliano (IT); Jürgen Cox, Munich (DE); Jacek R. Wisniewski, Krailling (DE)

(73) Assignee: Max-Planck-Gesellschaft zur Förderung der Wissenschaften E.V., München (DE)

( * ) Notice: Subject to any disclaimer, the term of this patent is extended or adjusted under 35 U.S.C. 154(b) by 7 days.

(21) Appl. No.: 13/500,460

(22) PCT Filed: Oct. 6, 2010

(86) PCT No.: PCT/EP2010/064922
§ 371 (c)(1),
(2), (4) Date: Jun. 21, 2012

(87) PCT Pub. No.: WO2011/042467
PCT Pub. Date: Apr. 14, 2011

(65) Prior Publication Data
US 2012/0264154 A1 Oct. 18, 2012

Related U.S. Application Data

(60) Provisional application No. 61/249,032, filed on Oct. 6, 2009.

(30) Foreign Application Priority Data

Oct. 6, 2009 (EP) ..................................... 09172382

(51) Int. Cl.
*C12Q 1/00* (2006.01)
*G01N 33/00* (2006.01)
*G01N 24/00* (2006.01)

(52) U.S. Cl.
USPC .................................. 435/4; 436/86; 436/173

(58) Field of Classification Search
USPC ........................................ 435/4; 436/86, 173
See application file for complete search history.

(56) References Cited

PUBLICATIONS

Zhong et al. Identification of Secreted Proteins That Mediate Cell-Cell Interactions in an In Vitro Model of Lung Cancer Microenvironment; Cancer Research, vol. 68, No. 17 (2008) pp. 7237-7245.*
Ishihama et al. Quantitative Mouse Brain Proteomics Using Culture-Derived Isotope Tags as Internal Standards; Nature Biotechnology, vol. 23, No. 5 (2005) pp. 617-621.*
Faca et al. Innovative Proteimic Approaches for Cancer Biomarker Discovery; Biotechniques, vol. 43, No. 3 (2007) pp. 279-283.*
Yanay et al. Evolution of Insect Proteomes: Insights Into Synapse Organization and Synaptic Vesicle Life Cycle; Genome Biology (2008) pp. R27.1-R.27.26.*
Andersen Jens S et al., "Nucleolar proteome dynamics" Nature (London) vol. 433, No. 7021, Jan. 6, 2005, pp. 77-83.
Ong Shao-En, et al., "A practical recipe for stable isotope labeling by amino acids in cell culture (SILAC)." Nature Protocols 2006, vol. 1, No. 6, 2006, pp. 2650-2660.
Krueger Marcus, et al., "SILAC mouse for quantitative proteomics uncovers kindlin-3 as an essential factors for red blood cell function", Cell, vol. 134, No. 2, Jul. 2008, pp. 353-364.
Hanke Stefan, et al., "Absolute SILAC for accurate quantification of proteins in complex mixtures down to the attomole level." Journal of Proteome Research. vol. 7, No. 3, Mar. 2008, pp. 1118-1130.
Patwardhan Anil J, et al., "Quantitative proteome analysis of breast cancer cell lines using 0-18-labeling and an accurate mass and time tag strategy", Proteomics, vol. 6, No. 9, May 2006, pp. 2903-2915.
Song Xiaomin et al., "iTRAQ experimental design for plasma biomarker discovery", Journal of Proteome Research, vol. 7, No. 7, Jul. 2008, pp. 2952-2958.
Yang, Ivana V. et al., "Within the fold: assessing differential expression measures and reproducibility in microarray assays." Genome Biology, vol. 3, No. 11, Oct. 24, 2002.
Geiger Tamar, et al. "Super-SILAC mix for quantitative proteomics of human tumor tissue." Nature Methods, vol. 7, No. 5, May 2010, p. 383.
PCT International Search Report dated Jan. 27, 2011 for International Application No. PCT/EP2010/064922.
Deeb, Sally J., et al. "Super-SILAC allows classification of diffuse large B-cell lymphoma subtypes by their protein expression profiles." Molecular & Cellular Proteomics 11.5 (2012): 77-89.
Li, Chen, et al. "Quantitative proteomics reveal up-regulated protein expression of the SET complex associated with hepatocellular carcinoma." Journal of proteome research 11.2 (2011): 871-885.
Boersema, Paul J., et al. "Quantification of the N-glycosylated secretome by super-SILAC during breast cancer progression and in human blood samples." Molecular & Cellular Proteomics 12.1 (2013): 158-171.
Schweppe, Devin K., James R. Rigas, and Scott A. Gerber. "Quantitative phosphoproteomic profiling of human non-small cell lung cancer tumors." Journal of proteomics 91 (2013): 286-296.
Zhang, Wen, et al. "Proteomic profiles of human lung adeno and squamous cell carcinoma using super-SILAC and label-free quantification approaches." Proteomics (2014).
Lund, Rikke Raaen, et al. "Quantitative proteomics of primary tumors with varying metastatic capabilities using stable isotope-labeled proteins of multiple histogenic origins." Proteomics 12.13 (2012): 2139-2148.

\* cited by examiner

*Primary Examiner* — Susan Hanley
*Assistant Examiner* — Paul Martin
(74) *Attorney, Agent, or Firm* — DT Ward, PC; Donna T. Ward; Lingyun Jia

(57) ABSTRACT

The present invention relates to a method that allows comprehensive quantitation of one or a plurality biomolecules, including the entire complement of biomolecules in a sample by comparing their quantity to the quantity of reference biomolecules in a standard mixture obtained via extraction from at least two different cell populations. The invention further relates to said standard mixture itself, its preparation and use.

20 Claims, 6 Drawing Sheets a.

b.

METHOD FOR QUANTIFYING BIOMOLECULES

CROSS REFERENCE TO RELATED APPLICATIONS

This application is a 35 U.S.C. §371 U.S. National Stage Entry of International Application No. PCT/EP2010/064922 filed Oct. 6, 2010, which claims the benefit of priority of European Application No. 09172382.5 filed Oct. 6, 2009 and U.S. Provisional Application 61/249,032 filed Oct. 6, 2009, the contents of which are each incorporated herein by reference in its entirety.

REFERENCE TO SEQUENCE LISTING

The present application is being filed along with a Sequence Listing in electronic format. The Sequence Listing is provided as a file entitled 52740US371.txt, created on Jun. 14, 2012, which is 42,691 bytes in size. The information in the electronic format of the sequence listing is incorporated herein by reference in its entirety.

FIELD OF THE INVENTION

This invention relates to a method that allows comprehensive quantitation of one or a plurality, including the entire complement of biomolecules in a sample by comparing their quantity to the quantity of reference biomolecules in a standard mixture obtained via extraction from at least two different cell populations. The invention further relates to said standard mixture itself, its preparation and use.

BACKGROUND OF THE INVENTION

The comprehensive quantitation of biomolecules and fragments of the biomolecules in a sample, such as proteins expressed by a genome, cell, tissue or organism, is a complex task.

In recent years, mass spectrometry has made great technological progress and is increasingly broadly applied (R. Aebersold and M. Mann, Nature 422 (6928), 198 (2003), B. F. Cravatt, G. M. Simon, and J. R. Yates, $3^{rd}$, Nature 450 (7172), 991 (2007)). However, accurate quantitation of the entire complement of biomolecules such as proteins expressed by a genome, cell, tissue or organism, e.g., a tumor proteome, by high resolution mass spectrometric methods is still in its infancy (F. Bertucci, D. Birnbaum, and A. Goncalves, Mol Cell Proteomics 5 (10), 1772 (2006), J. M. Koomen, E. B. Haura, G. Bepler et al., Mol Cell Proteomics 7 (10), 1780 (2008)).

A primary difficulty has been to quantify a representative number of biomolecules, which is a prerequisite for obtaining reproducible results, and for studying disease related biomolecules, which are often low abundant, such as cancer relevant proteins.

Molecular classification of certain disease states, e.g., tumors, can aid in patient segregation, selection of optimal treatment modalities and prediction of outcome. Measuring transcriptome levels with microarrays has shown promise for this application and is starting to be clinically applied (T. R. Golub, D. K. Slonim, P. Tamayo et al., Science (New York, N.Y 286 (5439), 531 (1999), X. Li, R. J. Quigg, J. Zhou et al., Current genomics 9 (7), 466 (2008)).

Stable isotope labeling by amino acids in cell culture (SILAC) is very accurate and robust, which makes it a valuable tool for quantifying proteomes (S. E. Ong, B. Blagoev, I. Kratchmarova et al., Mol Cell Proteomics 1 (5), 376 (2002), S. E. Ong and M. Mann, Nature protocols 1 (6), 2650 (2006)). For example, Chowdhury et al. (Rapid Communications in Mass Spectrometry 9: 563-569 (1995) used mass spectrometry and isotopically labeled analogs to investigate the molecular weight of truncated mature collagenase, and Stocklin et al. (Diabetes 46: 44-50 (1997) investigated human insulin concentration in serum samples that had been extracted and purified. Neither one discusses the determination of the quantity of biomolecules without prior isolation of the biomolecules, let alone determining the absolute quantity of a plurality of biomolecules comprised in a sample, e.g., the entire complement of biomolecules in such a sample.

Because SILAC requires complete metabolic labeling of the entire proteome, it has usually been limited to cell culture and is thought to be unsuitable for clinical samples. In recent years, a few studies have broadened the scope of SILAC. The Neuro2A cell line has been metabolically labeled and compared to total mouse brain (Y. Ishihama, T. Sato, T. Tabata et al., Nature Biotechnology 23 (5), 617 (2005)). A total of 602 proteins were quantified, albeit with up to 10-fold ratios between cell line and tissue. Such high ratios between sample and internal standard make accurate quantification difficult because the lower abundant peptide in the SILAC-pair may be close to the noise level.

Proteins from cultured primary hepatocytes 2 isolated from mouse liver using SILAC-labeled Hepa1-6 cells have been recently quantified (S. Pan, L. Cheng, J. T. White et al., Omics 13 (4), 345 (2009)). Furthermore, a mouse has been previously SILAC-labeled, but this method is not applicable to human subjects (M. Kruger, M. Moser, S. Ussar et al., Cell 134 (2), 353 (2008)).

There is therefore a need for a straightforward and rapid method for the quantitation of one or a plurality, e.g., the entire complement of biomolecules (e.g., proteins, oligonucleotides, etc.) in a sample, such as a human sample and particularly a human tissue sample, which furthermore allows to rapidly quantify a plurality of biomolecules, e.g., a part of, or the entire complement of biomolecules in such a sample, such as proteins expressed by a genome, cell, tissue or an organism.

The above object is solved by the methods according to the present invention as described and claimed herein.

(A) Experimental scheme of quantitative analysis of tumor tissue using labeled HCC1599 breast cancer cell line as internal standard. Lysate of labeled cells was mixed with tumor lysate at a ratio of 1:1. The mixture was digested and peptides were analyzed by high resolution liquid chromatography coupled to tandem mass spectrometry (LC-MS/MS).

(B) Five different cell types including 4 breast cancer cell lines and normal mammary epithelial cells were SILAC labeled. Equal protein amounts were mixed to form SUPER-SILAC mix, which was then mixed with the tumor tissue and analyzed as in (A).

(C) Histogram of the ratios between the tumor proteins and HCC1599 cells. The frequency represents the number of proteins in each bin.

(D) Histogram of the ratios between the tumor proteins and the SUPER-SILAC mix.

Figure 2:
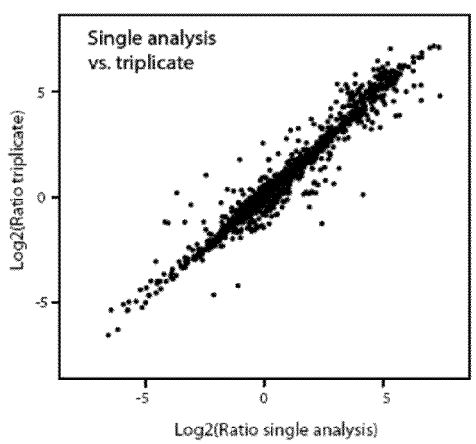
Figure 2:
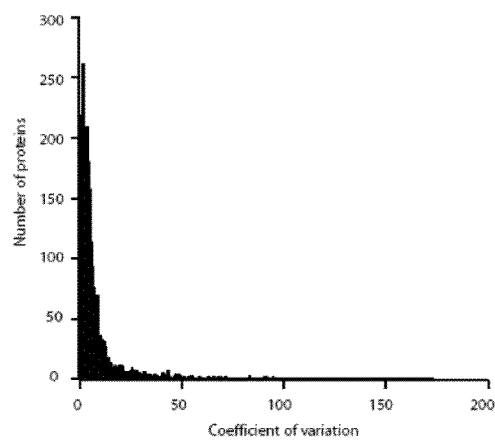
Figure 2:
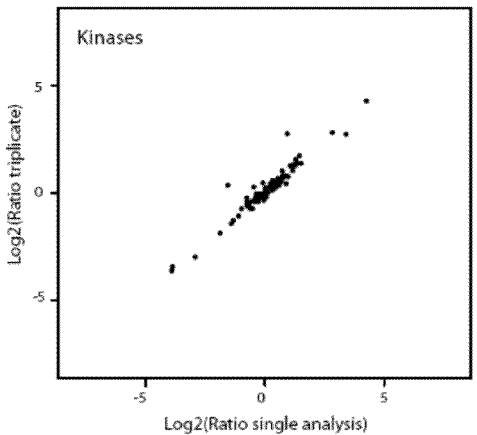
Figure 2:
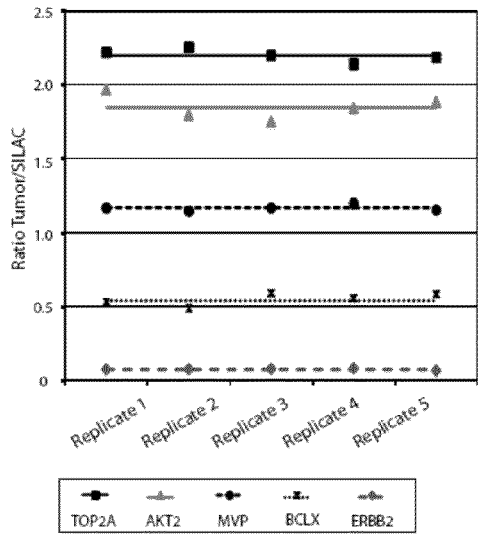

FIG. 2. Quantification accuracy using SUPER-SILAC mix.

(A) Comparison of the ratio determined in a single analysis to a combined triplicate analysis of the tumor proteome, with the SUPER-SILAC mix as internal standard.

(B) Histogram of the coefficient of variation of 3 technical replicates.

(C) Comparison of the ratio determined in a single analysis to a combined triplicate analysis of kinases expressed in the tumor.

(D) Ratios of 5 cancer related proteins in 5 replicates.

Figure 3:
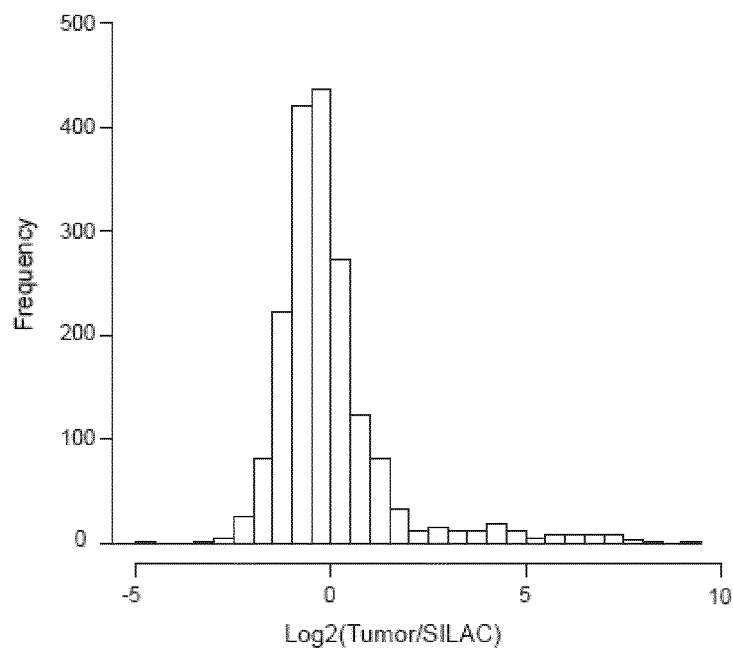
Figure 3:
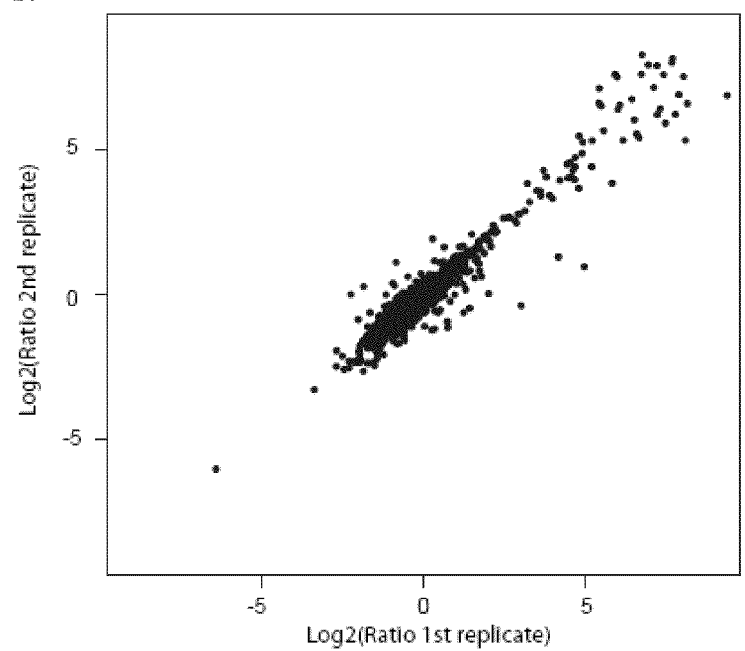

FIG. 3. Analysis of tumor tissue with a SUPER-SILAC mix as internal standard using the LTQ-ORBITRAP™ Velos mass spectrometer. Peptides were separated on a C18 column, without prior fractionation.

(A) Distribution of the ratios between the tumor proteins and the SILAC mix.

(B) Ratio compared between two technical replicates.

Figure 4:
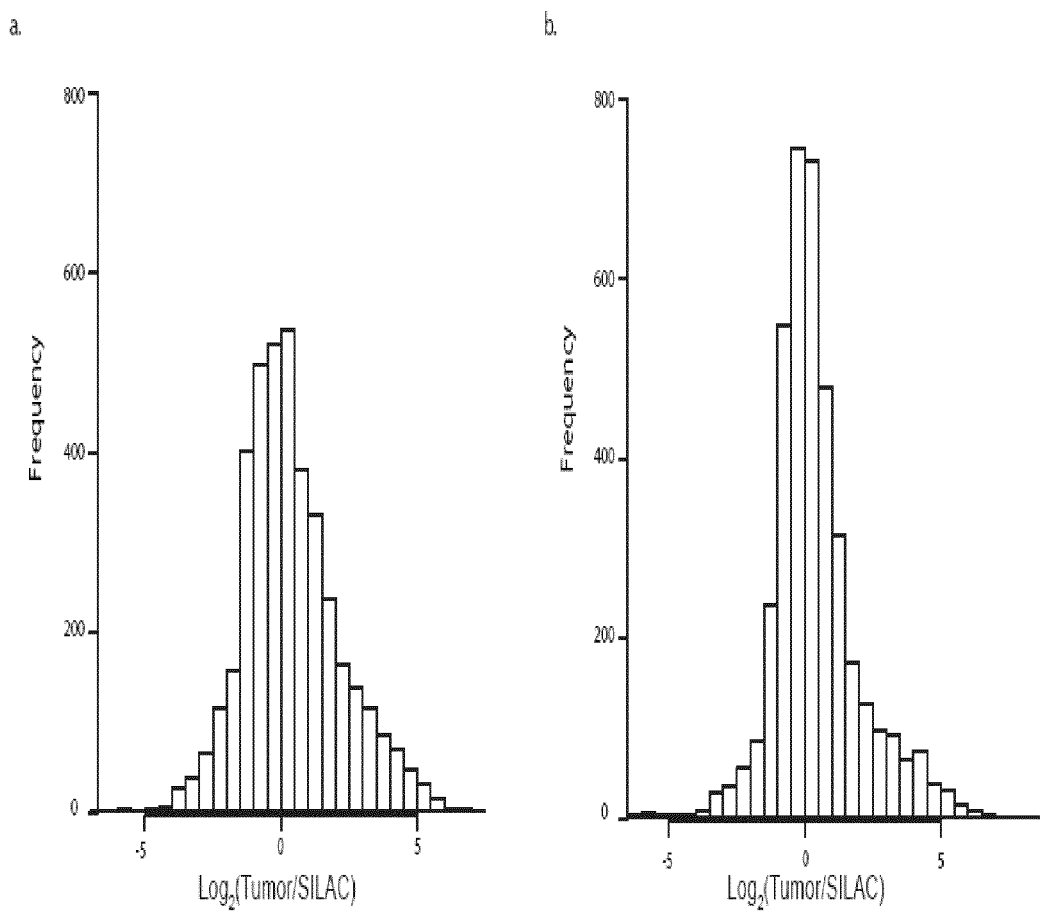

FIG. 4. Quantification of astrocytoma tissue with one SILAC-labeled cell type vs. super-SILAC mix.

(A) Histogramm of the rations between the tumor proteins and 1321N1 cells. The frequency represents the number of proteins in each bin.

(B) Histrogramm of the rations between the tumor proteins and the super-SILAC mix.

Figure 5:
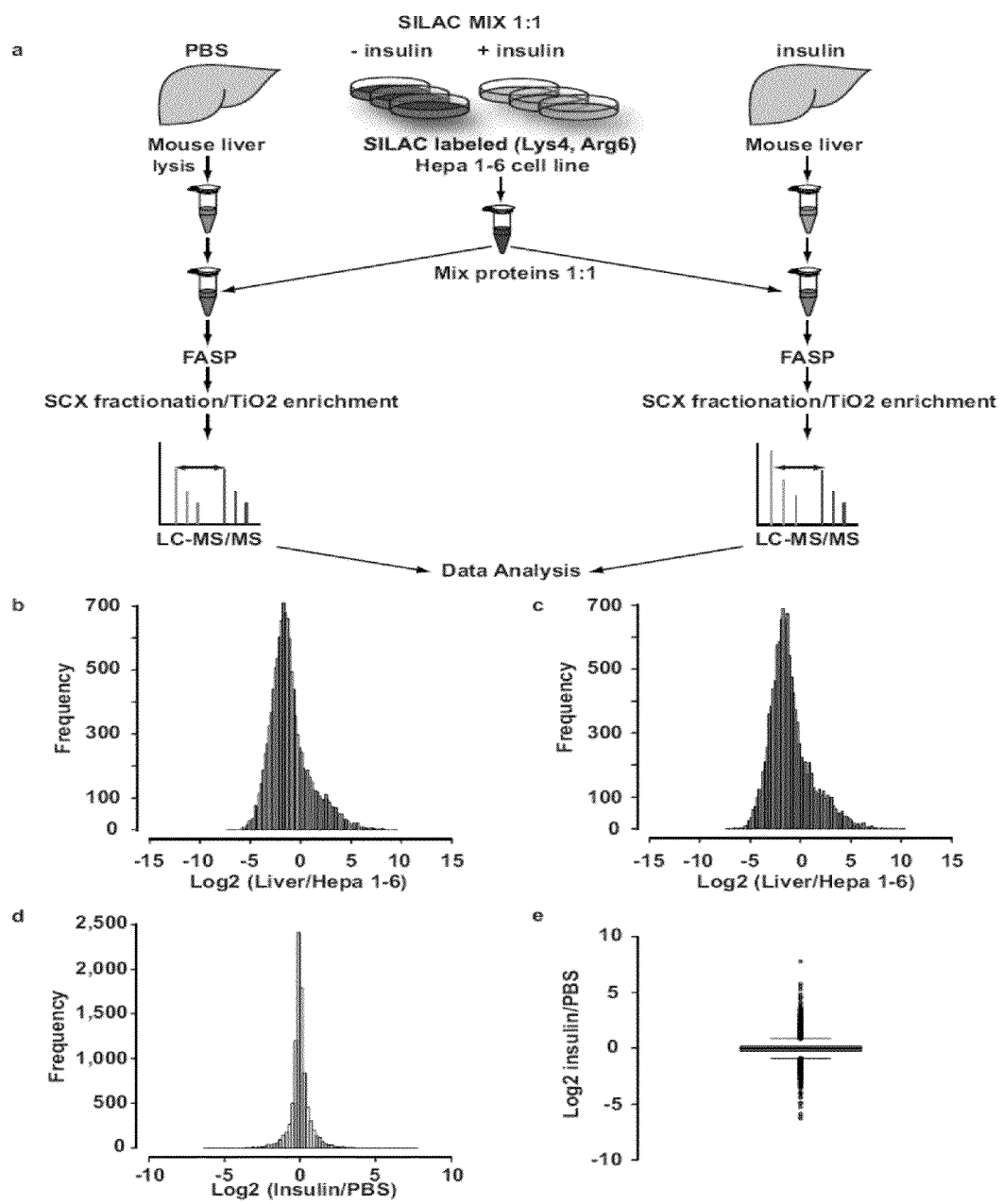

FIG. 5. Experimental design of liver quantitative phosphoproteomic analyses (A) Experimental design for quantitative phosphoproteomic analyses of control and insulin treated liver samples. A mixture of insulin treated and non treated labeled Hepa1-6 cells serves as internal standard. The mixtures are digested and the resulting peptides analyzed by high-resolution LC MS/MS. The ratios from the control and the insulin treated livers are then compared ('ratio of ratios').

(B, C) Distribution of the ratios between the phosphopeptides of the control livers and of the Hepa1-6 cells (B) and between phosphopeptides of insulin treated livers and of Hepa1-6 cells (C).

(D) Boxplot and (E) 'ratio of ratios' histogram of the phosphopeptides ratios between insulintreated and control livers samples (representative example of one technical replicate-triplicate distribution is even narrower).

Figure 6:
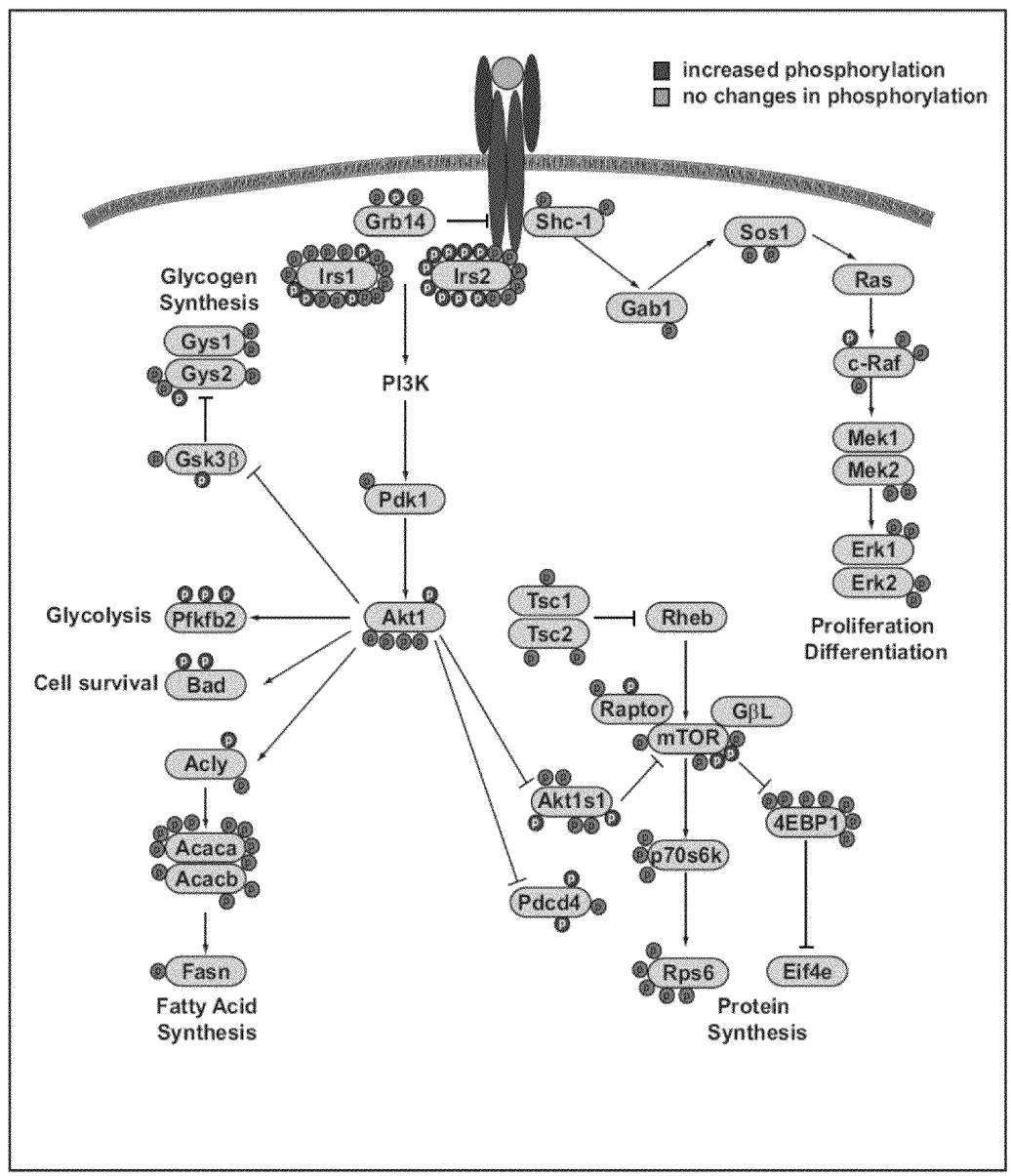

FIG. 6. Insulin signaling pathway members activated in liver upon insulin treatment.

After interacting with the insulin receptor tyrosine kinase, insulin activates a series of mediators that regulates the metabolic and mitogenic effects of insulin. Sites with increased phosphorylation after insulin treatment of mice are shown indicated with a white "p", those that are quantified but not regulated by insulin are labeled with a black "p."

DETAILED DESCRIPTION

Thus, in one aspect, the invention provides a method for quantifying one or a plurality of biomolecules in a sample, comprising determining the quantity of said one or said plurality of biomolecules in said sample; and comparing it to the quantity of one or a plurality of reference biomolecules amongst a plurality of biomolecules in a standard mixture, said plurality of biomolecules having been obtained via extraction from at least two different cell populations, for instance from a mixture of these cell populations; wherein said one or said plurality of reference biomolecules are a labeled form of said one or said plurality of biomolecules.

It is understood that the main embodiment refers to two groups of biomolecules. The first group is said one or a plurality of biomolecules in said sample, said group of biomolecules being also referred to as "first biomolecules" in the following. On the other hand there is mention of a plurality of biomolecules in a standard mixture, wherein it is understood that said standard mixture is to be held distinct from said sample. Accordingly, this second group of biomolecules which is said plurality of biomolecules in said standard mixture is also referred to as "second biomolecules" in the following. Accordingly, and when expressed using the terminology of first and second biomolecules, the main embodiment relates to a method for quantifying one or a plurality of first biomolecules in a sample, comprising determining the quantity of said one or said plurality of first biomolecules in said sample; and comparing it to the quantity of one or a plurality of reference biomolecules amongst a plurality of second biomolecules in a standard mixture, said plurality of second biomolecules having been obtained via extraction from at least two different cell populations, wherein said one or said plurality of reference biomolecules are a labeled form of said one or said plurality of first biomolecules.

In a preferred embodiment, the quantity of said one or said plurality of biomolecules in said sample, i.e., of said first biomolecules, is determined after mixing said standard mixture with said sample. The standard mixture thereby serves as an internal standard for the purposes of the methods and uses of the invention.

It will be appreciated that according to this aspect of the invention, the quantity of said one or said plurality of biomolecules and said one or said plurality of reference biomolecules is preferably determined by mass spectrometry.

Although not strictly mandatory, the above method may further comprise a step of sequencing of said one or said plurality of biomolecules.

In a preferred embodiment, the said one or said plurality of reference biomolecules in said standard mixture is/are preselected, and said mass spectrometrical analysis is targeted to this/these preselected reference biomolecule/s by single or multiple ion monitoring.

It will be further appreciated that in the above method, the comparing step comprises determining the ratio of intensities between a peak or the peaks of said one or said plurality of biomolecules and a corresponding peak or corresponding peaks of said one or said plurality of reference biomolecules. For example, the ratio may be obtained by first integrating the signal of said biomolecules prior to integrating the signal of said reference biomolecules, and then determining their ratio by dividing one signal by the other or vice versa.

In a preferred embodiment, the quantity/quantities of said one or said plurality of biomolecules is/are the absolute quantity/quantities. In this case, it will be appreciated that the quantity/quantities of said one or said plurality of reference biomolecules in said standard mixture is/are predetermined. It will be appreciated that the quantity/quantities of said one or said plurality of reference biomolecules in said standard mixture may be predetermined either before or after determining the quantity/quantities of said one or said plurality of biomolecules in said sample.

In a further, related aspect, the invention provides a standard mixture for quantifying one or a plurality of biomolecules in a sample, comprising one or a plurality of reference biomolecules amongst a plurality of biomolecules that have been obtained via extraction from at least two different cell populations, for instance from a mixture of these cell populations. Also encompassed by the present invention is the use of the afore-mentioned standard mixture in any of the methods described and claimed herein.

In yet a further, related aspect, the invention provides a method for preparing a standard mixture for quantifying one or a plurality of biomolecules in a sample, comprising extracting a plurality of biomolecules comprising one or a plurality of reference biomolecules from at least two different cell populations, for instance from a mixture of these cell populations.

It will be further appreciated that in the methods, standard mixtures and uses according to the present invention, the reference biomolecule/s is/are isotope labeled, preferably chemically or metabolically isotope labeled, and most preferably metabolically isotope labeled. In a particularly preferred embodiment, the metabolic isotope labeling is stable isotope labeling with amino acids in cell culture (SILAC), and the stable isotope is selected from the group consisting of $^{2}H$, $^{13}C$, $^{15}N$, $^{17}O$, $^{18}O$, $^{33}P$, $^{34}S$ and combinations thereof. Particularly preferred are embodiments where the stable isotope is selected from $^{13}C$ and $^{15}N$.

As mentioned earlier, in yet a further, related aspect, the invention provides the use of a standard mixture for quantifying one or a plurality of biomolecules in a sample. The standard mixture comprises one or a plurality of reference biomolecules amongst a plurality of biomolecules, the plurality of biomolecules having been obtained via extraction from at least two different cell populations, for instance from a mixture of these cell populations.

It will be appreciated that according to all aspects of the invention, the at least two different cell populations differ from each other in respect of cell morphology, expression profile of at least one biomolecule, preferably expression profile of a plurality of biomolecules, and/or state of differentiation. Provided this is the case, the at least two cell populations may be populations of
(i) cells of different cell types, for example primary cells of a different cell type or cells of cell lines of a different cell type;
(ii) cells of the same cell type, for example primary cells of the same cell type or cells of cell lines of the same cell type;
(iii) cells from different cell lines;
(iv) cells from the same cell line;
(v) cells of different cell lineages;
(vi) cells of the same cell lineage;
(vii) cells from different cell cultures, wherein the cultures have been subjected to different culture conditions; or
(viii) cells from the same cell culture, wherein the cells in the culture have been subjected to the same culture conditions.

Particularly preferred are options (i), (iii), (v) and (vii).

It will furthermore be appreciated that according to all aspects of the invention, the method, the sample is preferably a human sample and may be selected from the group of samples or human samples consisting of cells, such as tumor cells, for example blood associated tumor cells;
whole tissue or selected parts of a tissue;
healthy tissue;
tissue associated with a disease, such as chronic inflammation, metabolic disease, particularly diabetes, cardiovascular disease, tumor tissue, for example breast cancer tissue, other carcinoma tissue, sarcoma tissue, neuroendocrine tumor tissue, blood associated tumor tissue, lymphoma tissue, teratoma tissue, brain tumor tissue such as glioblastoma or astrocytoma tissue;
sub-cellular compartments of cells or tissue, e.g., mitochondria, nuclei, body fluids;
extracts of the above; and
selected protein fractions from the above, e.g., enriched membrane proteins, glycoproteins, phosphorylated proteins, acetylated proteins ubiquitinated proteins, proteins with other modifications and protein complexes.

In yet another preferred embodiment, the sample is a sample from diseased or pathologically changed tissue, preferably human tissue. Particularly preferred is human tumor tissue. In the context of this embodiment, it is preferred that at least one and preferably all of said at least two different cell populations correspond to diseased or pathologically changed cells in said diseased or pathologically changed tissue in terms of cell lineage. It is particularly preferred that at least one and preferably all of said at least two different cell populations correspond to diseased or pathologically changed cells in said diseased or pathologically changed tissue in terms of cell type.

As stated above, it is deliberately envisaged that not all of said at least two different cell populations correspond to diseased or pathologically changed cells. In other words, at least one of said at least two different cell populations may correspond to normal, i.e., non-diseased and not pathologically changed cells.

As indicated above, preferred embodiments of the various aspects of the invention described and claimed herein are those wherein said plurality of biomolecules has been obtained via extraction from a mixture of at least two different cell populations. It will be understood that in connection with these embodiments, said mixture may preferably contain equal, or substantially equal numbers of cells of each cell population. However, substantial deviations from this ratio are also contemplated as long as the resulting standard mixture contains a significant amount of biomolecules from each cell population. Significant amounts in this regard are at least 2% (w/w), at least 3% (w/w), at least 5% (w/w), at least 10% (w/w), at least 15% (w/w), at least 20% (w/w) or at least 25% (w/w) of the total amount of biomolecules in the standard mixture. The same applies if the standard mixture takes the form of a lyophilisate that may be reconstituted (which is likewise an embodiment of the aspects of the invention described and claimed herein).

Likewise preferred are embodiments of the various aspects of the invention described and claimed herein wherein said plurality of biomolecules has been obtained via mixing extracts obtained from at least two different cell populations, i.e., wherein the mixing is done after the different cell populations have been individually extracted, optionally after having counted the cells and adjusted the cell numbers. In this regard, it is preferred to perform the mixing of the previously obtained extracts in such a way that the extracts of each of the different cell populations contribute equally, or substantially equally, to the total amount of said plurality of biomolecules in said standard mixture. Again, however, substantial deviations from this ratio are also contemplated as long as the resulting standard mixture contains a significant amount of biomolecules from the extract of each cell population. Again, significant amounts in this regard are at least 2% (w/w), at least 3% (w/w), at least 5% (w/w), at least 10% (w/w), at least 15% (w/w), at least 20% (w/w) or at least 25% (w/w) of the total amount of biomolecules in the resulting standard mixture, be it in the form of a solution or a lyophilisate.

In further preferred embodiments of all aspects of the invention described and claimed herein the at least two different cell populations are three or more different cell populations, preferably four or more different cell populations, more preferably five or more different cell populations, six or more different cell populations, or ten or more different cell populations.

Particularly preferred are embodiments wherein said biomolecules are proteins or peptides.

Provided herein is inter alia a method that principally allows to comprehensively quantify one or a plurality of the biomolecules, or the entire complement of biomolecules, such as proteins expressed by a genome, cell, tissue or organism, in a biological sample, such as tumor tissue and the like. By virtue of this method, it is possible to efficiently produce hundreds or thousands of isotopically labeled biomolecules in correct amounts and to use these labeled biomolecules as reference biomolecules in a standard mixture for the mass spectrometric quantification of hundreds or thousands of corresponding biomolecules in a sample, such as proteins in a tumor tissue, in a day. This is exemplarily demonstrated herein on mammary carcinoma tissue from a patient with invasive ductal carcinoma, grade II. The new method is, however, more broadly applicable, economical and can be easily applied in laboratories which thus makes it an attractive tool for clinical studies.

In a first aspect, the invention provides a method for quantifying one or a plurality of biomolecules in a sample comprising determining the quantity of said one or a plurality of biomolecules in said sample.

The term "biomolecule" as used herein refers to any molecule produced by a living organism and may be selected from the group consisting of proteins, peptides, polysaccharides, carbohydrates, lipids, as well as analogs and fragments thereof. Preferred examples of biomolecules are proteins and peptides.

As used herein, the term "peptide" refers to a peptide or polypeptide of two or more amino acids. A peptide or polypeptide can also be modified, e.g., by naturally occurring modifications such as post-translational modifications, including phosphorylation, acylation, prenylation, sulfation, hydroxylation, acetylation, addition of carbohydrate, addition of prosthetic groups or cofactors, formation of disulfide bonds, proteolysis, assembly into macromolecular complexes, and the like.

In accordance with the present invention, the quantity of the one or the plurality of biomolecules as referred to herein is compared to the quantity of one or a plurality of reference biomolecules in a standard mixture. In a preferred embodiment, the quantity of said one or said plurality of biomolecules in said sample is determined after mixing said standard mixture with said sample.

As used herein, the term "standard mixture" refers to a mixture of one or a plurality of reference biomolecules amongst a plurality of biomolecules, said plurality of biomolecules (including said one or said plurality of reference biomolecules) having been obtained via extraction from at least two different cell populations, and wherein said one or said plurality of reference biomolecules are a labeled form of said one or said plurality of biomolecules (as defined above) in the sample.

The step of obtaining a plurality of biomolecules of the standard mixture is done in such a way that the relative quantity/quantities of said one or said plurality of reference biomolecules in said standard mixture compared to at least one or a plurality of further biomolecules within said plurality of biomolecules corresponds to the relative quantity/quantities of said one or said plurality of reference biomolecules compared to said at least one or plurality of further biomolecules when extracted from a mixture of said at least two different cell populations.

The invention also provides the standard mixture as defined above itself as well as a method for preparing such standard mixture for quantifying one or more biomolecules in a sample, said method comprising extracting a plurality of biomolecules comprising one or more reference biomolecules from at least two different cell populations.

In the context of the present invention, the term "reference biomolecule" refers to a labeled form of the biomolecules as defined above.

The term "labeled form" as used herein includes an isotope labeled form. Preferably, the labeled form is a chemically or metabolically isotope labeled, and most preferably a metabolically isotope labeled form of the biomolecule.

Preferred "isotope labeled forms" of biomolecules in accordance with the present invention are variants of naturally occurring molecules, in whose structure one or more atoms have been substituted with atom(s) of the same element having a different atomic weight, although isotope labeled forms in which the isotope has been covalently linked either directly or via a linker, or wherein the isotope has been complexed to the biomolecule are likewise contemplated. In either case, the isotope is preferably a stable isotope.

A stable isotope as referred to herein is a non-radioactive isotopic form of an element having identical numbers of protons and electrons, but having one or more additional neutron(s), which increase(s) the molecular weight of the element. Preferably, the stable isotopes are selected from the group consisting of $^{2}H$, $^{13}C$, $^{15}N$, $^{17}O$, $^{18}O$, $^{33}P$, $^{34}S$ and combinations thereof. Particularly preferred are $^{13}C$ and $^{15}N$, and combinations thereof.

The labeling can be effected by means known in the art. A labeled reference biomolecule can be synthesized using isotope labeled amino acids or peptides as precursor molecules. For example, isotope-coded affinity tag (ICAT) reagents label reference biomolecules such as proteins at the alkylation step of sample preparation (Gygi et al., 1999, WO 00/11208). Visible ICAT reagents (VICAT reagents) may be likewise employed (WO 04/019000), whereby the VICAT-type reagent contains as a detectable moiety a fluorophore or radiolabel. iTRAQ and similar methods may likewise be employed (Ross, P. L., Huang, Y. N., Marchese, J. N., Williamson, B., Parker, K., Hattan, S., Khainovski, N., Pillai, S., Dey, S., Daniels, S., et al. (2004). Multiplexed protein quantitation in *Saccharomyces cerevisiae* using amine-reactive isobaric tagging reagents. Mol Cell Proteomics 3, 1154-1169).

Metabolic labeling can also preferably be used to produce the labeled reference biomolecules. For example, cells can be grown on media containing isotope labeled precursor molecules, such as isotope labeled amino acids, which are incorporated into proteins or peptides, which are thereby metabolically labeled. The metabolic isotope labeling is preferably a stable isotope labeling with amino acids in cell culture (SILAC). If metabolic labeling is used, and the labeled form of the one or the plurality of reference biomolecules is a SILAC labeled form of the reference biomolecule/s, the standard mixture as defined above is also referred to as SUPER-SILAC mix.

An advantage of using metabolic labeling is that all peptides of each protein contribute to quantitation and that there is no need to target the analysis to specific proteins or peptides, although this is, of course, possible and intended in the framework of the present invention. Moreover, any peptide in the mixture can in principle be quantified, depending on the depth of analysis and the number of separation steps. This enables quantification of isoform specific peptides and modified peptides. As shown below, it is possible, for instance, to quantify almost 100 phosphorylated peptides without any enrichment steps (see Table 1). The SUPER-SILAC mix works in the same way for the phosphoproteome, however, for in depth phosphoproteomic analysis, a phosphopeptide enrichment step is preferably included.

The biomolecules of the standard mixture, i.e., the one or the plurality of reference biomolecules and the plurality of biomolecules, are obtained via extraction from at least two different cell populations, either from a mixture of such populations or by mixing extracts obtained individually from said populations. It will be appreciated that the plurality of biomolecules of the standard mixture may also be obtained via extraction from certain sub-cellular compartments of said at least two different cell populations, again either from mixtures of said compartments or by mixing extracts previously obtained individually from the compartments of individual cell populations. Suitable sub-cellular compartments in the context of the present invention are, e.g., cell nuclei, mitochondria, the endoplasmatic reticulum, the Golgi apparatus, the cytoplasm, or the cell membrane.

As mentioned earlier herein, the cells that may form the "at least two different cell populations" referred to herein, may be cells from cell lines, in particular tumor cell lines, or cells of primary cells in culture. The cells can be artificially modified by any means known in the art. Suitable cell lines are formed by cells that have undergone genetic changes allowing them to proliferate readily and indefinitely in culture. In other words they are immortalized cells. Any cell line known in the art is suitable to be used in the method according to the present invention, depending, of course, on the nature of the sample, and may be obtained from commonly known depositary institutions or "cell banks", such as the ATCC or the German Collection of Microorganisms and Cell Cultures (DSMZ). Particularly preferred cell lines are mammalian cell lines, particularly human cell lines.

Suitable primary cells can be directly obtained from tissue or body fluids, preferably human tissue or body fluids, and can be, for example, blood cells, lymphocytes, neuronal cells, glial cells, epithelial cells, fibroblastic cells, hepatocytes, muscle cells or cardiomyocytes.

In a preferred embodiment of the method of the invention, the plurality of biomolecules of the standard mixture is obtained via extraction from a mixture of at least three different cells, at least four different cells, at least five different cells, or at least ten different cells.

The term "different cell populations" means that the cells forming these populations differ either in their morphology from each other in respect of their cell morphology, the expression profile of at least one biomolecule as defined above and preferably of a plurality of biomolecules as defined above, and/or their state of differentiation. In a preferred embodiment, the cells are cells from a different cell type or cell lineage. Also preferred are, however, embodiments where the cells are from the same cell type or lineage, but differ in other respects. For instance, the cells may differ in that they are cells of the same cell type or lineage that were, however, cultured under different cell culturing conditions. Different cell culture conditions that may lead to different cell populations may be conditions with differences in cultivation temperature, cultivation atmosphere, cultivation medium, number of passages, cell density, and/or the substrate used. However, it will be appreciated that a given culture may well comprise different cell populations in the sense of the invention that are subjected to the same culture conditions (i.e., "mixed" cultures), as long as the cells of the different cell populations within that given culture differ in any of the other respects identified above.

Also preferred is the use of cell populations from different cell lines. These may be cells from cell lines belonging to different cell types or lineages. In a preferred embodiment, however, the cells of the different cell lines belong to the same cell lineage, or are derived from the same cell lineage. Also preferred are embodiments where the cells of the different cell lines belong to the same cell type, or are derived from the same cell type. Suitable cell lines are tumor cell lines, particularly carcinoma cell lines, sarcoma cell lines, lymphoma cell lines, leukemia cell lines, germ cell tumor cell lines, and blastoma cell lines, brain tumor cell lines such as glioblastoma and astrocytoma cell lines.

Examples of different cell types in the sense of the present invention are the cell types of the endocrine system, i.e., thyroid epithelial cell, parafollicular cells, parathyroid chief cells, oxyphil cells, chromaffin cells, -pinealocytes; the cell types of the nervous system, i.e., astrocytes, oligodendrocytes, microglia, neuronal cells, Schwann cells; and other cell types such as epithelial cells, fibroblasts, osteoblasts, osteocytes, osteoclasts, chondroblasts, chondrocytes, keratinocytes, melanocytes, myocytes, adipocytes, hepatocytes, B-cells, T-cells, natural killer cells, basophil granulocytes, eosinophil granulocytes, neutrophil granulocytes, monocytes, macrophages, mast cells, dendritic cells, pluripotent stem cells, omnipotent stem cells, and the like.

Examples of different cell lineages in the sense of the present invention are fibroblastic cells, endothelial cells, epithelial cells, myeloid cell, lymphoid cells, leukocytes, keratinocytes, osteoblasts, or osteoclasts, neuronal cells, stromal cells, thyroid cells, myocardiocytes, pneumocytes, liver cells, and the like.

Preferably, the "different cell populations" are cells of different cell lineages derived from the same tissue, such as the squamous cell lineage and the gland-like cell lineage derived from adenosquamous carcinoma tissue; or cells of different cell lines, such as different epithelial cell lines derived from breast cancer tissue, e.g., HCC-1143, HCC-1599, HCC-1937, HDQ-P1, BT-474, CAL-120, or DU-4475 cells derived from breast cancer tissue, or BFTC-900, CAKI-2, CAL-54 cell lines derived from kidney carcinoma tissue, or CL-40, DLD-1, HCT-116, SW-403, SW480 cell lines derived from colon carcinoma tissue. In another preferred embodiment, the different cell populations comprise cells from different cell lines derived from human tumor tissue and cell lines derived from the corresponding healthy tissue.

In yet another preferred aspect of the invention, the "different cell populations" are different cell types of the same cell lineage, such as B- and T-cells belonging to the leukocyte lineage.

The cell forming the different cell populations may be distinguished, e.g., by altered DNA, RNA, cell surface marker expression, gene expression, biochemical properties, enzyme activity, behavior, proliferation, apoptosis, nutritional requirements, tissue formation or any other feature that is a manifestation of the above-defined differences.

Techniques for identifying and detecting different cell populations are well known in the art. For example, common techniques for detecting differences between cells include PCR methods such as normal PCR, real-time PCR, RT-PCR, in-situ hybridization, and the like; or marker detection methods such as flow cytometry, magnetic bead separation, microscopy and the like; or protein detection techniques such as SDS page, 3D-Gels, Western blotting, microarrays, mass spectrometry and the like; or hybridisation techniques such as in-situ hybridization, FISH, microarrays, Southern blotting, Northern blotting and the like; or DNA mutation analyzing techniques such as restriction fragment-length polymorphism (RFLP) and the like.

As used herein, the term "sample" refers to cells, sub-cellular compartments thereof, tissue or organs. The tissue may be a whole tissue, or selected parts of a tissue. Tissue parts can be isolated by micro-dissection of a tissue, or by biopsy, or by enrichment of sub-cellular compartments. The term "sample" further refers to healthy as well as diseased or pathologically changed cells or tissues. Hence, the term further refers to a cell or a tissue associated with a disease, such as a chronic inflammation, a metabolic disease, in particular diabetes, a cardiovascular disease, a tumor, in particular carcinoma, breast cancer, sarcoma, neuroendocrine tumor, blood associated tumor, lymphoma, teratoma or brain tumor such as glioblastoma or astrocytoma. A sample can be cells that are placed in or adapted to tissue culture. A sample can also be a body fluid such as plasma, lymphe, blood, urine, saliva, serum, cerebrospinal fluid, seminal plasma, pancreatic juice, breast milk, or lung lavage. A sample can additionally be a cell or tissue from any species, including prokaryotic and eukaryotic species, preferably humans, as well as a viral sample.

A tissue sample can be further a fractionated or preselected sample, if desired, preselected or fractionated to contain or be enriched for particular cell types. The sample can be fractionated or preselected by a number of known fractionation or preselection techniques.

A sample can also be any extract of the above. The term also encompasses protein fractions from cells or tissue, such as cells enriched with membrane proteins, glycoproteins, phosphorylated proteins, acetylated proteins, ubiquitinated proteins, proteins with other modifications and protein complexes.

It has been found by the present inventors that mixing the cells from two or more different cell populations, or mixing extracts from two or more different cell populations, in accordance with the methods, standard mixtures and uses described and claimed herein unexpectedly improves quantification accuracy.

This applies in particular in situations where standard mixtures are used that are intended to "match" the sample to be analyzed. For example, if it is desired to quantify the biomolecules contained in a sample from tumor tissue, it is preferred in accordance with the invention to select a matching standard mixture, i.e., a standard mixture obtained, e.g., via extraction from cells from a set of different cell lines belonging to the same cell type, or derived from the same cell type, as the tumor tissue, or a certain population of cells within the tumor tissue, optionally supplemented by cells of the same cell type derived from corresponding healthy tissue. Obtaining standard mixtures from at least two different cells allows for a broader coverage of the biomolecules comprised in the sample, e.g., proteins comprised in the tumor tissue, compared to the situation if a standard mixture was obtained from only one cell.

Also contemplated are standard mixtures which are tailored for use for the quantitation of the proteins found in different tissues, e.g., for the "staging" or "molecular characterization" of different tissues. For instance, in one aspect, a standard mixture obtained from different sets of tumor cell lines may be prepared which due to the choice of the different cell populations chosen for extraction represents a given stages of tumor development, or various stages of tumor development. By quantitating a matching tumor sample with this standard mixture, it is possible to perform accurate "staging" of the tumor tissue in respect of a variety of tumor markers within hours. This could be done even during surgical operation on a fresh tumor specimen.

For example, various cell lines derived from epithelial cells may be used for the preparation of a standard mixture suitable for quantifying the biomolecules in carcinoma tissue such as breast-, prostate-, lung- and colon-cancer tissue; cell lines derived from hematopoietic (blood-forming) cells may be used for the preparation of a standard mixture suitable for quantifying the biomolecules in lymphoma and leukemia samples; or different cell lines derived from mesenchymal cells may be used for the preparation of a standard mixture suitable for quantifying the biomolecules in sarcoma tissue.

In this regard, it is also advantageous to include at least one cell population for extraction that is obtained from the corresponding healthy tissue of the tumor to be characterized, or that is derived from such cells via culturing and optionally transformation or immortalization.

Figure 1:
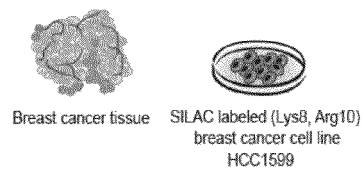
FIG. 1. Quantitation of tumor tissue with one SILAC-labeled cell type vs. SUPER-SILAC mix.
Figure 1:
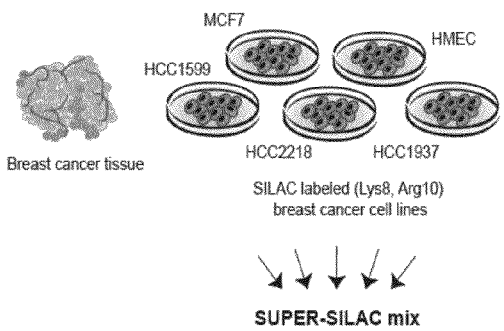
Figure 1:
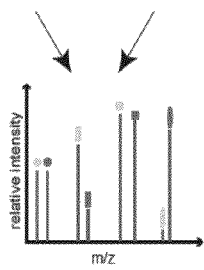
Figure 1:
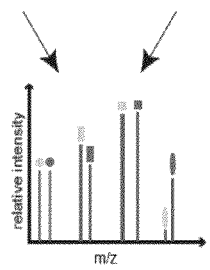
Figure 1:
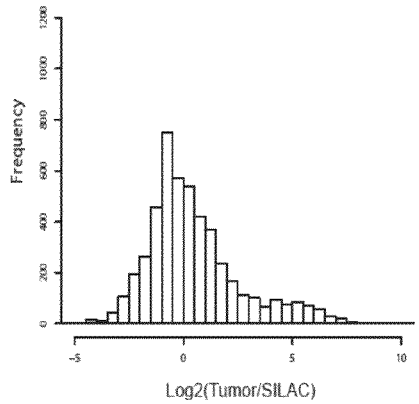
Figure 1:
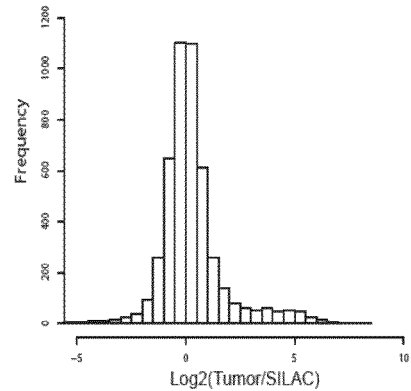

In the context of the present invention, the inventors SILAC-labeled the breast cancer cell line HCC1599 and mixed the lysate with lysate of mammary carcinoma tissue from a patient with invasive ductal carcinoma, grade II. The resulting protein mixture was digested according to the FASP protocol (J. R. Wisniewski, A. Zougman, N. Nagaraj et al., Nature methods 6 (5), 359 (2009)) and the peptides were separated into six fractions by anion exchange chromatography in a StageTip format (J. R. Wisniewski, A. Zougman, and M Mann, submitted (2009)). Each fraction was analyzed by online reverse-phase chromatography coupled to high resolution, quantitative mass spectrometric analysis (FIG. 1A and Examples 4 and 5). Although 4438 proteins were quantified in triplicate analysis, the ratio distribution was broad and bimodal, containing 755 proteins with more than four-fold higher expression in the tumor compared to the cell line (FIG. 1C). Thus, the proteome of a single cell line does not adequately represent the tumor proteome and therefore cannot be used for accurate quantification. Next, four breast cancer cell lines differing in origin, stage, and estrogen receptor and ErbB2 expression were selected. Adding a normal mammary epithelial cell type to the SILAC-mix increased quantitative accuracy. This mixture was termed SUPER-SILAC as it is a superset of SILAC cell lines, which accurately represents the tissue.

Determining whether the standard mixture accurately represents the tissue can be performed, for example, by determining the ratios of the quantities of the reference biomolecules and the biomolecules in said sample. The closer these ratios are to one, the more similar the standard mixture is to the tissue, and as a result, the more precise the quantification is. For example, when the quantities of the majority (e.g. more than 50%) of the biomolecules in the standard mixture is less than two-fold different from the quantities of the biomolecules in said sample, the standard mixture can be considered an accurate reference. This approach has been used in the Examples enclosed herewith. Using such measure of accurate tissue representation, the superior performance of an exemplary standard mixture of five cell lines has been quantified.

A further approach to designing a standard mixture which accurately represents a tissue is to analyze separately each of the candidate cell populations as well as the tissue. Such analyzing may be done by mass spectrometry. This comparison can highlight the cell lines which are similar to the tissue and the combination of cell populations that is necessary for standard mixture accurately representing the tissue.

Adding the labeled mixture of cell lines, rather than the single cell line, to the tumor achieved the same depth in triplicate analysis but drastically improved quantification accuracy (FIG. 1B, D). The distribution was now unimodal and 90% of quantified proteins were within a four-fold ratio between the tumor and the SUPER-SILAC mix (3837 of 4286 protein groups). Furthermore, the quantitative distribution was much narrower with 76% of the proteins in the carcinoma and the SUPER-SILAC mix differing only two-fold or less. Comparing a single analysis to a triplicate of the same tumor, a correlation of 0.97 was found, with 90% of the proteome yielding the same ratio within a factor of 1.5 (FIG. 2A). The high quantification accuracy may be attributed to the fact that every protein is quantified several times through multiple MS scans and through multiple peptides. These multiple quantification events per protein lead to high accuracy even in single 3 analyses. Comparison of three replicates revealed a very low coefficient of variation (CV), with a mean value of 4% (FIG. 2B). Thus several thousand proteins are quantified with an error of a few percent, which is much more accurate than methods used in clinical practice today.

The standard mixture according to the present invention can also be used for absolute quantification of biomolecules in a sample. In order to achieve an estimation of the amounts of the individual biomolecules in the sample, one can calculate the abundance of each of the biomolecules compared to other biomolecules in the sample, based on the intensity of the signal. Considering that one knows the absolute amount of the biomolecule that is injected to the instrument, it is possible to estimate the absolute amounts of each of the biomolecules in the sample. In order to get more accurate measurement of biomolecules of interest, it is possible to analyze the reference biomolecules in the standard mixture according to the invention together with biomolecules of known amount, and compare their amounts. The absolute quantification using standards can be performed on the standard mixture of the invention, not the samples. This analysis can also be performed retrospectively. Knowing the amounts of the reference biomolecules in the standard mixture of the invention enables automatically absolute quantification of all biomolecules in all of the samples. Similarly, estimation of the absolute amounts of the biomolecules (without standard) can be done only on the standard mixture of the invention, and the amounts of biomolecules in the samples can be extrapolated from that. Hence, when the method is used for absolute quantitation of one or a plurality of biomolecules in a sample, the quantity of the one or the plurality of reference biomolecules in the standard mixture is predetermined. It will be appreciated by those skilled in the art that the quantity of said one or said plurality of reference biomolecules in said standard mixture may either be determined before determining the quantity of said one or said plurality of biomolecules in said sample, or afterwards.

The methods of the present invention further allow for identification and quantitation of protein modification in the tissue sample. The standard mixture according to the invention may contain thousands of biomolecules such as peptides, among them modified peptides (e.g. phosphorylated peptides, acetylated peptides etc.). In the same way as the proteome analysis, such modified peptides in the standard mixture can enable quantitation of modified peptides in the tissue. Modified peptides can be identified with or without prior enrichment. In the simple case, without enrichment, the mass spectrometric analysis is performed regularly, and the bioinformatic analysis considers the option of modified peptides. In the latter case, the standard mixture is mixed with the tissue and enrichment step is performed on the mixture.

The quantity of said one or said plurality of biomolecules and said one or said plurality of reference biomolecules is preferably determined by mass spectrometry. Preferably, the comparing step comprises determining the ratio of intensities between a peak or the peaks of said one or said plurality of biomolecules and a corresponding peak or corresponding peaks of said one or said plurality of reference biomolecules. For example, the ratio may be obtained by first integrating the signal of said biomolecule/s prior to integrating the signal of said reference biomolecule/s, and then determining their ratio by dividing one signal by the other or vice versa.

It is understood that said determining, in particular in the context of using mass spectrometry, further comprises an enzymatic digestion. Enzymes suitable for said enzymatic digestion include trypsin.

A variety of mass spectrometry systems can be employed in the methods of the invention for identifying and/or quantifying a biomolecule in a sample, such as a polypeptide. Mass analyzers with high mass accuracy, high sensitivity and high resolution include, but are not limited to, matrix-assisted laser desorption time-of-flight (MALDI-TOF) mass spectrometers, electrospray ionization time-of-flight (ESI-TOF) mass spectrometers, Fourier transform ion cyclotron mass analyzers (FT-ICR-MS), and ORBITRAP™ analyzer instruments. Other modes of MS include ion trap and triple quadrupole mass spectrometers. In ion trap MS, analytes are ionized by electrospray ionization or MALDI and then put into an ion trap. Trapped ions can then be separately analyzed by MS upon selective release from the ion trap. Ion traps can also be combined with the other types of mass spectrometers described above.

Fragments can also be generated and analyzed. Reference biomolecules labeled with an ICAT or VICAT or iTRAQ type reagent, or SILAC labeled peptides can be analyzed, for example, by single stage mass spectrometry with a MALDI-TOF or ESI-TOF or single ORBITRAP™ analyzer system. Methods of mass spectrometry analysis are well known to those skilled in the art (see, for example, Yates, J. Mass Spect. 33: 1-19 (1998); Kinter and Sherman, Protein Sequencing and Identification Using Tandem Mass Spectrometry, John Wiley & Sons, New York (2000); Aebersold and Goodlett, Chem. Rev. 101: 269-295 (2001); Griffin et al., Curr. Opin. Biotechnol. 12: 607-612 (2001)).

For high resolution peptide fragment separation, liquid chromatography ESI-MS/MS or automated LC-MS/MS, which utilizes capillary reverse phase chromatography as the separation method, can be used (Yates et al., Methods Mol. Biol. 112: 553-569 (1999)). Data dependent collision-induced dissociation (CID) with dynamic exclusion can also be used as the mass spectrometric method (Goodlett, et al., Anal. Chem. 72: 1112-1118 (2000)).

Mass-spectrometric analysis of the biomolecules in a sample, e.g., a tissue, with the standard mixture according to the invention, can be targeted, and can include SIM-scans (single ion monitoring) to increase sensitivity, e.g., 10 to 100 fold or more. Previous embodiments have all dealt with non-targeted analysis of peptides, however, it is also possible to pre-determine one or a plurality of biomolecules of interest, such as peptides of interest, and target the analysis to them. Novel algorithms can match between a "master run" and the experiment run in real time, and identify the targeted biomolecule(s). When the biomolecule(s) is or are found, SIM scans can be performed. In the SIM-scan only the specific mass window is selectively accumulated, therefore dramatically increasing the sensitivity. It will be appreciated that the targeted biomolecule needs to be detected only in the standard mixture according to the invention, and then, with the increased sensitivity, it will be monitored also in the sample. With the SIM scan, it is then possible to achieve accurate quantification even for biomolecules that are very low in the sample. Furthermore, in depth characterization of the standard mixture before the quantitation of the biomolecules in the sample allows targeting of one or a plurality of biomolecules, e.g., the entire complement of biomolecules, for example peptides, in the sample even without their detection in the mass spectra. This is possible because the chromatographic elution time of the biomolecules of interest, such as peptides of interest, have been determined before. Furthermore, the chromatographic elution time of the other biomolecules in the standard mixture can be used to precisely estimate the elution time of the biomolecule(s) of interest during the measurements.

It will be appreciated by those skilled in the art, that in the same way, targeted analysis by Single or Multiple Reaction Monitoring (SRM or MRM) techniques known in the art (see for example, Picotti, P., Bodenmiller, B., Mueller, L. N., Domon, B., and Aebersold, R. (2009): Full dynamic range proteome analysis of S. cerevisiae by targeted proteomics. Cell 138, 795-806) can be used to increase the sensitivity of the measurement. Instead of monitoring a narrow mass range, specific transitions from the precursor to specific fragments are monitored.

The method of the present invention may further comprise sequencing of said biomolecules in said sample. However, it is one of the advantages of the present invention that the standard mixture can also be used for quantification of biomolecules in a sample using a mass-spectrometer without sequencing capabilities (e.g. Exactive mass spectrometer from Thermo Fisher Scientific). In this case, the reference biomolecules in a standard mixture according to the invention may be initially analyzed in depth, with a "sequencing" mass-spectrometer (e.g., LTQ-ORBITRAP™ Velos mass spectrometer from Thermo Fisher Scientific). The results of such analysis create a database of all the reference biomolecules, e.g., all the peptides, in the standard mixture. In the next step, a large number of samples can be analyzed by matching between the runs. An algorithm matches between the runs from the two types of instruments based on the retention times and the exact mass of the reference biomolecule, e.g., the peptide (based on ppm or sub-ppm mass accuracy). The one or the plurality of biomolecules, e.g., the peptides, from each sample, are quantified by comparing each of them to the reference biomolecules of the standard mixture according to the invention, while the identity of the biomolecules, e.g., the peptides, is taken from the in-depth analysis of the standard mixture according to the invention. The standard mixture according to the invention should be analyzed as deeply as possible by pre-fractionation and separation, in order to identify high proportion of the entirety of biomolecules in the sample, e.g., the proteome.

As will be appreciated from the above, the methods of the present invention can be applied to the detection and quantification of biomolecules associated, e.g., with a disease, e.g., a tumor disease or a genetic disease. As such, a disease known to be associated with aberrant expression of a polypeptide can be analyzed using methods of the invention by including a standard mixture of the invention comprising reference biomolecules corresponding to the aberrantly expressed polypeptide.

The reagents and methods of the invention are also applicable to diagnosing and determining the prognosis for various diseases. For example, one can create a standard mixture enriched with membrane proteins, to enable quantitation of membrane proteins in the tissue. Such analysis can be of great importance for the development of drug targets and diagnostic markers.

The methods of the invention are particularly useful for diagnosis of diseases, such as tumors or other diseases. For example, the methods can be used to diagnose a disease such as muscular dystrophy, including Duchenne muscular dystrophy or Becker muscular dystrophy by measuring decreased expression of dystrophin. Similarly, the methods of the invention can be used to quantify the expression of prostate related proteins for diagnosis of prostate cancer. The methods of the invention can also be used to identify markers and/or diagnose other cancers such as lung, colon, liver, ovary, breast, brain or other cancers.

One skilled in the art will readily recognize that the methods of the invention are applicable to these and other diseases associated with aberrant expression of one or a plurality of polypeptides.

One skilled in the art can furthermore readily apply the methods of the invention to the analysis of known markers and yet unknown markers associated with a disease.

The methods of the invention are also applicable to the detection and quantification of patterns of protein expression that are diagnostic or prognostic for a disease. The methods can be used in diagnostic applications in body tissues probed by biopsy. The method can also be used in body fluids such as blood, serum or plasma, cerebrospinal fluid, urine, saliva, seminal plasma, pancreatic juice, breast milk, lung lavage, and the like. Because the methods can be used to analyze and quantify multiple biomolecules in the same analysis, the methods are particularly useful for diagnostic applications, since the ability to analyze multiple biomolecules in the same analysis allows multiple biomolecules correlated with a diagnostic application to be used rather than the analysis of one diagnostic marker alone. Thus, the methods can be applied, e.g., to the analysis of multiple diagnostic markers associated with a disease. Once a set of diagnostic markers has been identified, the methods of the invention can be applied to quantify the set of markers for an analysis that is expected to be more informative than the analysis of a single diagnostic marker alone.

Using the method of the present invention, diagnostic patterns of protein expression can be determined by direct comparative, quantitative protein profiling of tissues or body fluids of persons afflicted or potentially afflicted with a particular disease and the standard mixture of the invention.

Further, kinases are fundamental proteins in malignant processes, but are often not detected in proteomic studies. Despite their low abundance the present inventors identified more than a hundred protein kinases and quantified most of them very accurately (median CV 6%, Table 2). Among these kinases, ErbB2, EGFR, AKT, PAK1, 2 and nine members of the MAPK cascade were quantified, all representing pathways central to malignancy. It was investigated whether this proteome contained quantified proteins that have been associated with sensitivity to breast cancer chemotherapy. A recent review lists 80 factors previously suggested to be involved in chemosensitivity and drug resistance in a variety of cancers, 18 of which were examined in breast cancer (I. Sekine, C. Shimizu, K. Nishio et al., International journal of clinical oncology/Japan Society of Clinical Oncology 14 (2), 112 (2009)). The analysis showed that at least 50 proteins out of this list were expressed in the tumor investigated, of which 38 were accurately quantified (median CV 3.5%; Table 3). FIG. 2D visualizes precision of quantification of five of these proteins in replicate measurements, giving information about receptor status (ERBB2), expression levels of the DNA unwinding protein topoisomerase 2 (TOP2A), upregulation of a drug exporter (MVP) and resistance to apoptosis (BCLX and AKT2). ErbB2, the target of trastuzumab (Herceptin™), was quantified with 23 peptides even though it was much less expressed in the tumor compared to the standard mixture of the present invention (0.08±0.006). The DNA unwinding protein TOP2A, target of 4 chemotherapeutic agents such as etoposide and doxorubicin was expressed 2.20±0.04 fold more highly in the tumor (quantified from 30 peptides). Immunohistochemical methods currently allow assessing the presence or absence of a few of these markers at most in a given patient sample. In contrast, the application of the standard mixture of the present invention in clinical studies would enable quantification of large numbers cancer-relevant proteins simultaneously.

The above measurement used six peptide fractions and single or triplicate measurement, requiring one or three days of analysis time, respectively. The present inventors next investigated if the method could be streamlined further by omitting any peptide fractionation. A new generation orbitrap mass spectrometer with higher sequencing speed (LTQ-Orbitrap Velos) was used and the total peptide digest loaded directly on the chromatography column. Using this simple procedure, the present inventors were able to identify over 2100 proteins in triplicate runs, and quantify almost 1500 of them. As SILAC uniformly labels the entire cellular proteome, quantitative accuracy is independent of the depth of the proteome that is covered. Indeed, despite the lower proteome coverage, the distribution of the ratios did not change, as well as the quantification accuracy (Pearson correlation coefficient 0.97; FIG. 3).

In addition to the high proteome coverage and accurate quantification, another advantage of the use of the standard mixture of the present invention as internal standard for tissue quantification is its low cost. Standard 15 cm size cell culture dishes provide mix for about 20-120 triplicate analyses (depending on fractionation). Thus, reagent costs per analysis are only a few cents, including the required SILAC amino acids (Table 4). The standard mixture of the present invention can be produced in batch mode, sufficient for thousands of samples, and distributed in SDS-buffer in sealed aliquots adequate for a single or triplicate analysis. This is very similar to the way cell lysates are already distributed for checking antibodies, for example, and does not provide any logistical challenge. In the clinical chemistry laboratory, sample preparation will only consist of combining tissue lysates with the standard mixture of the present invention, followed by standard mass spectrometric analysis. The standard mixture of the present invention enables accurate determination of the levels of thousands of biomolecules, and in particular, proteins, in clinical studies for correlation with tumor type or treatment response and for the discovery of new tumor markers. The standard mixture of the present invention may also be routinely applicable to the systems-wide characterization of biopsies in the clinic as a basis for treatment decisions. The standard mixture and method of the invention is likewise suited for the quantification of biomolecules associated with other tumors, diseases or tissues.

In view of the above, it will be appreciated that the invention comprises the following items:

1. A method for quantifying one or a plurality of biomolecules in a sample, comprising
determining the quantity of said one or said plurality of biomolecules in said sample; and comparing it to the quantity of one or a plurality of reference biomolecules amongst a plurality of biomolecules in a standard mixture, said plurality of biomolecules having been obtained via extraction from at least two different cell populations;
wherein said one or said plurality of reference biomolecules are a labeled form of said one or said plurality of biomolecules.

2. The method of item 1, wherein said quantity of said one or said plurality of biomolecules in said sample is determined after mixing said standard mixture with said sample.

3. The method of items 1 or 2, wherein the quantity of said one or said plurality of biomolecules and said one or said plurality of reference biomolecules is determined by mass spectrometry.

4. The method of item 3, wherein said one or said plurality of reference biomolecules in said standard mixture are preselected, and the mass spectrometrical analysis is targeted to them by single or multiple ion monitoring.

5. The method of any one of the preceding items, further comprising sequencing of said biomolecules in said sample.

6. The method of any one of items 3 to 5, wherein said comparing step comprises determining the ratio of intensities between a peak or the peaks of said one or said plurality of biomolecules and a corresponding peak or the corresponding peaks of said one or said plurality of reference biomolecules.

7. The method of any one of the preceding items, wherein said quantity of said one or said plurality of biomolecules is the absolute quantity.

8. The method of item 7, wherein the quantity of said one or said plurality of reference biomolecules in said standard mixture is predetermined.

9. The method of item 8, wherein the quantity of said one or said plurality of reference biomolecules in said standard mixture is predetermined before determining the quantity of said one or said plurality of biomolecules in said sample.

10. The method of item 8, wherein the quantity of said one or said plurality of reference biomolecules in said standard mixture is predetermined after determining the quantity of said one or said plurality of biomolecules in said sample.

11. A standard mixture for quantifying one or a plurality of biomolecules in a sample, comprising one or a plurality of reference biomolecules amongst a plurality of biomolecules that have been obtained via extraction from at least two different cell populations.

12. A method for preparing a standard mixture for quantifying one or a plurality of biomolecules in a sample, comprising extracting a plurality of biomolecules comprising one or a plurality of reference biomolecules from at least two different cell populations.

13. Use of a standard mixture for quantifying one or a plurality of biomolecules in a sample, said standard mixture comprising
one or a plurality of reference biomolecules amongst a plurality of biomolecules, said plurality of biomolecules having been obtained via extraction from at least two different cell populations.

14. The method of any one of items 1 to 10 or 12, the standard mixture of item 11, or the use of item 13, wherein said at least two different cell populations differ from each other in respect of cell morphology, expression profile of at least one biomolecule, preferably expression profile of a plurality of biomolecules, and/or state of differentiation.

15. The method of any one of items 1 to 10, 12 or 14, the standard mixture of item 11 or 14, or the use of item 13 or 14, wherein said at least two different cell populations are populations of
(i) cells of different cell types, for example primary cells of a different cell type or cells of cell lines of a different cell type;
(ii) cells of the same cell type, for example primary cells of the same cell type or cells of cell lines of the same cell type;
(iii) cells from different cell lines;
(iv) cells from the same cell line;
(v) cells of different cell lineages;
(vi) cells of the same cell lineage;
(vii) cells from different cell cultures, wherein the cultures have been subjected to different culture conditions; or
(viii) cells from the same cell culture, wherein the cells in the culture have been subjected to the same culture conditions.

16. The method, the standard mixture, or the use of item 15, wherein the same or different cell types according to items (i) and (ii), respectively, are selected from the cell types of the endocrine system, i.e., thyroid epithelial cell, parafollicular cells, parathyroid chief cells, oxyphil cells, chromaffin cells, -pinealocytes; the cell types of the nervous system, i.e., astrocytes, oligodendrocytes, microglia, neuronal cells, Schwann cells; and other cell types such as epithelial cells, fibroblasts, osteoblasts, osteocytes, osteoclasts, chondroblasts, chondrocytes, keratinocytes, melanocytes, myocytes, adipocytes, hepatocytes, B-cells, T-cells, natural killer cells, basophil granulocytes, eosinophil granulocytes, neutrophil granulocytes, monocytes, macrophages, mast cells, and dendritic cells, pluripotent stem cells, and omnipotent stem cells.

17. The method, the standard mixture, or the use of item 15, wherein the same or different primary cells according to items (i) and (ii), respectively, are selected from primary blood cells, primary lymphocytes, primary neuronal cells, primary glial cells, primary epithelial cells, primary fibroblastic cells, primary hepatocytes, primary muscle cells, primary pluripotent or omnimotent stem cells and primary cardiomyocytes.

18. The method, the standard mixture, or the use of item 15, wherein the same or different cell lines according to items (i), (ii), (iii), and (iv), respectively, are tumor cell lines.

19. The method, the standard mixture, or the use of item 18, wherein the same or different cell lines according to items (i), (ii), (iii), and (iv), respectively, are selected from a carcinoma cell line, a sarcoma cell line, a lymphoma cell line, a leukemia cell line, a germ cell tumor cell line, and a blastoma cell line.

20. The method, the standard mixture, or the use of item 18, wherein the same or different cell lines according to items (i), (ii), (iii), and (iv), respectively, are selected from cell lines derived from breast cancer tissue, e.g., HCC-1143, HCC-1599, HCC-1937, HCC2218, MCF7, HDQ-P1, BT-474, CAL-120, or DU-4475; cell lines derived from kidney carcinoma tissue, e.g., BFTC-900, CAKI-2, CAL-54; cell lines derived from colon carcinoma tissue, e.g., CL-40, DLD-1, HCT-116, SW-403, SW480; cell lines derived from lung carcinoma tissue, e.g., NCI-H1395, NCI-H1437, NCI-H2009, NCI-H2087, NCI-H2122, NCI-H2126, NCI-H1770, NCI-H82, NCI-H209, NCI-H2171, A-549, DLKP; and cell lines derived from prostate cancer, e.g., LNCaP, PC-3, and DU-145.

21. The method, the standard mixture, or the use of item 15, wherein the same or different cell lineage according to items (v) and (vi), respectively, are selected from the lineages of fibroblastic cells, endothelial cells, epithelial cells, myeloid cell, lymphoid cells, leukocytes, keratinocytes, osteoblasts, or osteoclasts, neuronal cells, stromal cells, thyroid cells, myocardiocytes, pneumocytes, and liver cells.

22. The method, the standard mixture, or the use of item 15, wherein the same or different culture conditions according to items (vii) and (viii), respectively, are the same or different in respect of cultivation temperature, cultivation atmosphere, cultivation medium, number of passages, cell density, and/or the substrate used.

23. The method, the standard mixture, or the use of any one of the preceding items, wherein said sample is selected from the group of samples consisting of cells, such as tumor cells, for example blood associated tumor cells;
whole tissue or selected parts of a tissue;
healthy tissue;
tissue associated with a disease, such as chronic inflammation, metabolic disease, particularly diabetes, cardiovascular disease, tumor tissue, for example breast cancer tissue, other carcinoma tissue, sarcoma tissue, neuroendocrine tumor tissue, blood associated tumor tissue, lymphoma tissue, and teratoma tissue;
sub-cellular compartments of cells or tissue, e.g., mitochondria or cell nuclei;
body fluids;
extracts of the above; and
selected protein fractions from the above, e.g., enriched membrane proteins, glycoproteins, phosphorylated proteins, acetylated proteins ubiquitinated proteins, proteins with other modifications and protein complexes.

24. The method, the standard mixture, or the use of any one of the preceding items, wherein said sample is a sample from diseased or pathologically changed tissue, particularly tumor tissue, and wherein at least one and preferably all of said at least two different cell populations correspond to diseased or pathologically changed cells in said tissue in terms of cell lineage and/or cell type.

25. The method, the standard mixture, or the use of item 24, wherein at least one of said at least two different cell populations is a population of cells obtained from the corresponding healthy tissue, or derived from such cells via culturing and optionally transformation or immortalization.

26. The method, the standard mixture, or the use of any of the preceding items, wherein said plurality of biomolecules are biomolecules having been obtained via extraction from sub-cellular compartments of said cell populations or are enriched membrane proteins, glycoproteins, phosphorylated proteins, peptides, or fractions thereof.

27. The method, the standard mixture, or the use of any of the preceding items, said plurality of biomolecules having been obtained via extraction from a mixture of at least two different cell populations.

28. The method, the standard mixture, or the use of item 27, wherein said mixture of at least two different cell populations contains substantially equal numbers of cells of each cell population.

29. The method, the standard mixture, or the use of any of the preceding items, said plurality of biomolecules having been obtained via mixing extracts obtained from at least two different cell populations.

30. The method, the standard mixture, or the use of item 29, wherein said mixing is done in such a way that the extract of each cell population contributes substantially equally to the total amount (w/v) of said plurality of biomolecules or the volume of said standard mixture.

31. The method, the standard mixture, or the use of any of the preceding items, wherein said at least two different cell populations are three or more different cell populations, four or more different cell populations, five or more different cell populations, six or more different cell populations, or ten or more different cell populations.

32. The method, the standard mixture, or the use of any one of the preceding items, wherein said biomolecules are selected from the group consisting of proteins, peptides, polysaccharides, carbohydrates, lipids, as well as analogs and fragments thereof.

33. The method, the standard mixture, or the use of any one of the preceding items, wherein said biomolecules are proteins or peptides.

34. The method, the standard mixture, or the use of any one of the preceding items, wherein said one or said plurality of reference biomolecules are isotope labeled, preferably chemically or metabolically isotope labeled, and most preferably metabolically isotope labeled.

35. The method, the standard mixture, or the use of item 34, wherein the metabolic isotope labeling is stable isotope labeling with amino acids in cell culture (SILAC).

36. The method, the standard mixture, or the use of item 34 or 35, wherein the stable isotope is selected from the group consisting of $^{2}H$, $^{13}C$, $^{15}N$, $^{17}O$, $^{18}O$, $^{33}P$, $^{34}S$ and combinations thereof.

It will be appreciated that the following examples are intended to illustrate but not to limit the present invention. Various other examples and modifications of the foregoing description and examples will be apparent to a person skilled in the art after reading the disclosure without departing from the spirit and scope of the invention, and it is intended that all such examples or modifications be included within the scope of the appended claims. All publications and patents referenced herein are hereby incorporated by reference in their entirety.

EXAMPLES

The Examples illustrate the invention.

Example 1

Tissue Homogenization

A frozen sample of invasive ductal carcinoma (grade II) was kindly provided by Dr. Piotr Ziolkowski (Department of Pathology, Wroclaw Medical University, Poland). Analysis of the samples followed an informed consent approved by the local ethics committee. Frozen tumor tissue (100 mg) was homogenized in 0.5 ml buffer (100 mM Tris-HCl pH 7.6, 0.1M DTT) using an IKA Ultra Turbax blender at maximum speed (25000 rpm) at 4° C. SDS was then added to the homogenate to a final concentration of 4%. The lysate was incubated at 95° C. for 5 min, and then shortly sonicated. The lysate was centrifuged at 14,000 rpm for 10 min, and the supernatant was used for the following steps.

Example 2

SILAC Labeling and Preparation of SILAC Mix

Human mammary epithelial cells (HMEC) were obtained from Lonza. HMEC were SILAC labeled by culturing them in Gibco™ Defined Keratinocyte-SFM (Invitrogen) where the natural lysine and arginine were replaced by heavy isotope labeled amino acids, L-13C6 15N4-arginine (Arg10) and L-13C6 15N2-lysine (Lys8). Labeled amino acids were purchased from Cambridge Isotope Laboratories, Inc, USA. HCC1599, MCF7 and HCC1937 were obtained from the German Collection of Microorganisms and Cell Cultures (DSMZ). HCC2218 were purchased from the American Type Culture Collection (ATCC). HCC1599, HCC2218 and HCC1937 were SILAC labeled by culturing them in RPMI in which the natural Lysine and Arginine were replaced by Lys8 and Arg10 and supplemented with dialyzed serum. MCF7 were grown in DMEM containing Lys8 and Arg10 instead of the natural amino acids, and supplemented with 10% dialyzed serum. Cells were cultured for approximately 8 doublings in the SILAC medium to reach complete labeling. Lysis of HMEC, HCC1937 and MCF7 cells was performed on sub-confluent cultures. HCC2218 and HCC1599, which grow in suspension, were lysed in a state of exponential growth. All cells 2 were washed with PBS prior to lysis and lysed with a buffer containing 4% SDS, 100 mM Tris-HCl pH 7.6 and 100 mM DTT. Lysates were incubated at 95° C. for 5 min, and then shortly sonicated. Protein concentrations were determined by tryptophan fluorescence emission at 350 nm using excitation wavelength of 295 nm. The measurements were performed in 8M urea using tryptophan as the standard. For preparation of SUPER-SILAC mix, equal amounts of each of the lysates were mixed and used in the following steps.

Example 3

Filter Aided Sample Preparation (FASP)

Equal protein amounts of the tumor lysate and the SILAC mix were combined and diluted in 8 M urea in 0.1 M Tris-HCl pH 8.0 (approximately 1:8). Sample was loaded on MICROCON® centrifugal filter devices YM-30 (Millipore), and FASP protocol was performed as described previously (J. R. Wisniewski, A. Zougman, N. Nagaraj et al., Nature methods 6 (5), 359 (2009)). Briefly, MICROCON® centrifugal filter devices were centrifuged at 14,000×g at room temperature for 15 min, followed by 2 successive washes with the urea solution. Subsequently 100 μL of 50 mM iodoacetamide in 8 M urea in 0.1 M Tris-HCl, pH 8.0 were added to the lysate and incubated in the dark for 20 min. Following incubation, devices were washed twice with 8 M urea, and twice with 40 mM ammonium bicarbonate. Trypsin was added to the concentrate at a ratio of 1:50 (μg trypsin: μg protein), and incubated over night at 37° C. Peptides were collected from the filter by centrifugation, and two subsequent washes with 40 mM ammonium bicarbonate. The peptide concentration was determined by UV-absorbance at 280 nm.

Example 4

Peptide Fractionation by Strong Anion Exchange (SAX)

40 μg of peptides were separated by anion exchange chromatography. The column was assembled by stacking 6 layers of 3M™ EMPORE™ Anion Exchange ammonium-coated styrenedivinylbenzene copolymer disk (Varian, 1214-5012) into a 200 μl micropipette tip. Columns were activated with methanol, followed by a wash with 1 M NaOH. Equilibration and elutions were done in Britton & Robinson buffer composed of 20 mM acetic acid, 20 mM phosphoric acid, and 20 mM boric acid titrated with NaOH to the following pH values: 11, 8, 6, 5, 4, and 2. Peptides were loaded onto the columns in pH 11, and subsequently eluted with the buffers of six different pH values. Eluted peptides were bound to stage-tips as described previously (J. Rappsilber, Y. Ishihama, and M. Mann, Analytical chemistry 75 (3), 663 (2003)). Peptides were eluted from the StageTips prior to LC-MS/MS using Buffer B (80% acetonitrile, 0.5% acetic acid) (J. V. Olsen, L. M. de Godoy, G. Li et al., Mol Cell Proteomics 4 (12), 2010 (2005)).

Example 5

LC-MS Analysis

Peptides eluted from the StageTips were separated by reverse-phase chromatography on an in-house made 15 cm column (inner diameter 75 μm, 3 μm ReproSil-Pur C18-AQ media), using a nanoflow HPLC system (Proxeon Biosystems). HPLC was coupled on-line via a nanoelectrospray ion source (Proxeon Biosystems) to a LTQ-ORBITRAP™ mass spectrometer (Thermo Scientific) or to an LTQ-ORBITRAP™ Velos mass spectrometer (Thermo Scientific). Peptides were loaded onto the column with buffer A (0.5% acetic acid) with a flow rate of 500 nl/min, and eluted with 190 min linear gradient at a flow rate of 250 nl/min. Three different gradients were applied for fractions from the different pH values. A gradient from 2-30% buffer B was applied to fractions eluted with pH 11 and pH 8 solutions. 5-35% buffer B for pH 6 and pH 5 solutions, and 8-37% buffer B for pH4 and pH2. After the linear gradient the column was washed reaching 90% buffer B and re-equilibrated with buffer A. LC-runs coupled to the LTQ-ORBITRAP™ Velos mass spectrometer, were performed with a 15 cm column (inner diameter 75 µm, 1.9 µm REPROSIL-PUR® C18-AQ porous spherical silica media). 190 min gradients from 5-30% buffer B were used.

Mass spectra were acquired in the positive ion mode applying a data-dependent automatic switch between survey scan and tandem mass spectra (MS/MS) acquisition. Proteome samples were analyzed with a 'top 5' method in the LTQ-ORBITRAP™ mass spectrometer measurements, and 'top 15' in the LTQ-ORBITRAP™ Velos mass spectrometer measurements, acquiring one ORBITRAP™ analyzer survey scan in the mass range of m/z 300-2000 followed by MS/MS of the five most intense ions in the LTQ. The target value in the ORBITRAP™ analyzer was 1,000,000 for survey scan at a resolution of 60,000 at m/z 400 using lock masses for recalibration to improve the mass accuracy of precursor ions 3. Fragmentation in the LTQ was performed by collision-induced dissociation with a target value of 5,000 ions. Ion selection threshold was 1000 counts.

Example 6

Data Analysis

Raw MS files from the LTQ-ORBITRAP™ mass spectrometer and LTQ-ORBITRAP™ Velos mass spectrometer were analyzed by MaxQuant (J. Cox and M. Mann, *Nature biotechnology* 26 (12), 1367 (2008)) (version 1.0.13.12). MS/MS spectra were searched against the decoy IPI-human database version 3.62 containing both forward and reverse protein sequences, by the MASCOT search engine (version 2.2.04, Matrix Science) (D. N. Perkins, D. J. Pappin, D. M. Creasy et al., *Electrophoresis* 20 (18), 3551 (1999)).

Parent mass and fragment ions were searched with maximal initial mass deviation of 7 ppm and 0.5 Th, respectively. The search included variable modifications of methionine oxidation and Nterminal acetylation, and fixed modification of cystein carbamidomethylation. Peptides of minimum 6 amino-acids and maximum of two missed cleavages were allowed for the analysis. For peptide and 4 protein identification false discovery rate (FDR) was set to 0.01. In case the identified peptides of two proteins were shared by two proteins (homologs or isoforms), the two proteins were reported by MaxQuant as one protein group. For identification of peptide modifications, the search included phospho(STY) variable modification.

Example 7

Preparation of a Further SILAC Mix

We also developed a super-SILAC mix for a different tumor type. We combined five cell lines originating from glioblastomas and astrocytomas to serve as internal standard for analysis of these tumor types (Table 5). We mixed it with a lysate of astrocytoma protoplasmaticum and compared results to those with a single labeled astrocytoma cell line, 1321N1. In this brain tumor, we identified 5,183 protein groups and quantified 4,318 of them. Similar to our previous results, the ratio distribution of the super-SILAC mix was much narrower than that of the single cell line. Sixty-three percent of the quantified brain tumor proteome was within a very easily quantifiable twofold ratio to the internal standard verus 48% for the single cell line (FIG. 4). Therefore, the super-SILAC strategy is applicable to diverse tumor types.

Example 8

Quantification of the Liver Phosphoproteome Response to Insulin Stimulation

We generated a phosphopeptide standard by metabolically labeling mouse hepatoma Hepa1-6 cells with heavy forms of lysine (Lys4) and arginine (Arg6). Cells were divided into two populations, one of which was stimulated with insulin to achieve an adequate representation of insulin-dependent phosphorylation sites in the standard (FIG. 5a). Compared to chemically synthesizing labeled phosphopeptides, the standard has several advantages. Firstly, it should lead to the economical generation of tens of thousands of standard peptides present at roughly the desired amounts for accurate quantitation. Secondly, it allows mixing the standard with the sample early in sample processing, avoiding quantification errors introduced during the proteomics workflow.

We spiked the phospho-SILAC standard into liver tissue lysates from control and insulin injected animals. To determine if our standard mixture contains most of the phosphopeptides of the liver sample at the appropriate abundance to yield quantifiable ratios, we analyzed the histogram of SILAC ratios. The ratio distribution of phosphopeptides is unimodal, indicating that there is a good match between liver and cell line phosphoproteomes and that most of the light phosphopeptides from the sample of interest have counterparts in the heavy labeled internal standard (FIGS. 5b and 5c).

The comparison of liver samples with the standard generates a heavy to light (H/L) ratio between the two SILAC forms of the peptide. As the internal standard is the same across all the samples, the 'ratio of ratios' between the insulin treated and control samples allows direct comparison of phosphopeptide abundances. The distribution of the 'ratio of ratios' between insulin treated and PBS treated mice was remarkably narrow, demonstrating high accuracy of quantitation (FIG. 5d, e). The narrow distribution also implies that the large majority of phosphorylation sites are not regulated in response to insulin.

We identified one or more phosphorylation sites in almost all the known players of the insulin signaling pathway (FIG. 6). Examples include the key signaling mediators Irs1 and Irs2, for which we quantified more than two-fold changes in the phosphorylation of several serine sites after insulin stimulation (Table 6a). In contrast to tyrosine phosphorylation, serine/threonine phosphorylation of Irs proteins is implicated in the inhibition of the insulin signaling cascade. While Irs1 has been studied intensively little is known about serine phosphorylation on Irs2. Our data suggest that in mouse liver, in analogy to Irs1, serine phosphorylation on Irs2 plays a role in the inhibitory feedback mechanism involved in the adaptation of the pathway to prolonged insulin stimulation.

In liver, metabolic effects of insulin lead to increased glycolysis, glycogen synthesis and fatty acid synthesis. Accordingly, we observed an increase of phosphorylation of Gsk3_ on serine 9, a downstream target of Akt (Table 6b). Phosphorylation of this serine on Gsk3_ leads to its inhibition and, as a consequence activation of glycogen synthase. Serine 455 phosphorylation of ATP citrate lyase, the enzyme that converts citrate to acetyl-CoA and oxaloacetate, increased 2-fold (Table 6b). Phosphorylation of this site by Akt is thought to activate the enzyme, leading to increased supply of acetyl-CoA for fatty acid synthesis. Similarly, we detected a higher level of serine 469 and serine 486 phosphorylation (Table 6b)

(S466 and S483 in human) of 6-phosphofructo-2-kinase/fructose-2,6-biphosphatase (Pfkfb2), which although known as the 'cardiac isoform' is expressed in many tissues, including liver. Studies on this isoform in vitro have shown that these phosphorylation sites are involved in induction of glycolysis. An important branch of insulin signaling is mediated by mTOR kinase. Demonstrating activation of this pathway, we detected greater phosphorylation of Akt1-substrate 1 (also known as PRAS40) on threonine 247 and serine 184 after insulin treatment. This phosphorylation event is mediated by mTOR and dissociates PRAS40 from Raptor. Our dataset also suggests a previously unknown connection between insulin signaling and mTOR complex 2 (mTORC2) since we found increased phosphorylation of the mTORC2 specific subunit Rictor. Consistent with the central function of mTOR signaling in the response to insulin, mTOR kinase phosphorylation was also up-regulated at a previously unknown site (S2478; Table 6a).

In addition, we detected an increase in the inhibitory serine 76 phosphorylation of Pdcd4, a target of p70s6k. Pdcd4 prevents translation by binding to the translation initiation factor eIF4A and thus inhibiting its interaction to eIF4G. Phosphorylation of Pdcd4 on Ser76 mediates its degradation, relieving this inhibition and therefore enhancing protein translation. In addition, phosphorylation of Pdcd4 on Ser457 is also increased. This phosphorylation, mediated by Akt, inhibits the function of Pdcd4 as a repressor of AP-1 responsive promoters, providing a mechanism for insulin dependent upregulation of AP-1 transcriptional targets.

Besides the Akt and mTOR signaling branches, the insulin signaling network uses MAPK cascade to mediate its proliferative effects. In contrast to Akt and mTOR pathways, we did not detect any changes of phosphorylation levels of the regulatory threonine and tyrosine sites of Erk1 and Erk2. These data are consistent with earlier reports that show that Erk1 and Erk2 are only transiently phosphorylated 5-10 min after insulin stimulation. Similarly, we found the inhibitory serine 233 on Raf1 to be more phosphorylated after insulin stimulation (Table 6a). In contrast to Erk1 and Erk2, but still in agreement with a previous report, Mapk14 (p38a) phosphorylation was detected only in the insulin stimulated livers 30. Our large-scale phosphorylation data thus reveal complex patterns and cross-talk of signaling downstream of the insulin receptor.

TABLE 1

Supplementary Table 1:
Phosphosites detected in the tumor sample using SUPER-SILAC mix. PEP-posterior error probability

| Gene Names | Position | Localization Prob | Number of Phosphosites | Amino Acids | PEP | PTM Score | Modified Sequence | Ratio H/L Tumor/ SILAC | SEQ ID NO. |
|---|---|---|---|---|---|---|---|---|---|
| ABHD4 | 49 | 1.00 | 1 | S | 7.2E-04 | 108.8 | _FLARYVS(ph)LPNQNK_ | 51.94 | 1 |
| ACIN1 | 216 | 1.00 | 1 | S | 2.9E-13 | 136.9 | _SSSISEEKGDS(ph)DDEKPR_ | 1.87 | 2 |
| ACIN1 | 365 | 1.00 | 1 | S | 1.7E-03 | 120.7 | _TTS(ph)PLEEEER_ | 1.04 | 3 |
| AGAP1 | 607 | 1.00 | 1 | S | 7.9E-04 | 101.1 | _GLESRADSIGS(ph)GRAIPIK_ | 0.13 | 4 |
| AHNAK | 135 | 1.00 | 1 | S | 6.6E-94 | 221.7 | _LKS(ph)EDGVEGDLGETQSR_ | 0.69 | 5 |
| AHNAK | 5841 | 1.00 | 1 | S | 7.7E-111 | 243.2 | _GHYEVTGS(ph)DDETGK_ | 0.67 | 6 |
| AHNAK | 5845 | 0.97 | 1 | T | 7.7E-111 | 243.2 | _GHYEVTGSDDET(ph)GK_ | 0.74 | 7 |
| AHSG | 204 | 1.00 | 1 | S | 7.6E-26 | 195.0 | _CDSSPDS(ph)AEDVR_ | 408.68 | 8 |
| AKT1S1 | 203 | 1.00 | 1 | S | 4.5E-04 | 112.0 | _S(ph)LPVSVPVWGFK_ | 0.41 | 9 |
| ALB | 82 | 1.00 | 1 | S | 6.4E-48 | 226.6 | _TCVADES(ph)AENCDK_ | 130.82 | 10 |
| ANK3 | 1833 | 1.00 | 1 | S | 9.5E-04 | 106.8 | _LS(ph)LHEEEGSSGSEQK_ | 0.08 | 11 |
| AP3D1 | 658 | 1.00 | 1 | S | 2.2E-06 | 126.1 | _HRPS(ph)EADEEELAR_ | 1.20 | 12 |
| ARHGEF2 | 980 | 1.00 | 1 | S | 6.0E-32 | 187.0 | _S(ph)LPAGDALYLSFNPPQPSR_ | 0.24 | 13 |
| ARRB1 | 404 | 1.00 | 1 | S | 9.8E-14 | 124.6 | _GMKDDKEEEEDGTGS(ph)PQLNNR_ | 1.88 | 14 |
| ATP6V1C1 | 204 | 1.00 | 2 | S | 2.2E-03 | 93.9 | _LPVVVLLTVLY(ph)ES(ph)DLVFDK_ | 6.27 | 15 |
| ATRX | 677 | 0.97 | 1 | S | 5.7E-07 | 93.5 | _RPTETNPVTSNS(ph)DEECNETVK_ | 1.70 | 16 |
| B4DQZ7* | 380 | 1.00 | 1 | S | 1.0E-05 | 96.5 | _ELLVPQHTVQLVGGLS(ph)PLSSPSDTK_ | 0.86 | 17 |
| BCKDHA | 371 | 1.00 | 1 | S | 7.8E-16 | 147.7 | _IGHHS(ph)TSDDSSAYR_ | 2.69 | 18 |
| BCLAF1 | 177 | 1.00 | 1 | S | 7.3E-36 | 183.2 | _KAEGEPQEES(ph)PLK_ | 1.59 | 19 |
| BCLAF1 | 512 | 1.00 | 1 | S | 2.5E-03 | 94.8 | _LKDLFDYS(ph)PPLHK_ | 1.88 | 20 |
| BNIP2 | 235 | 1.00 | 1 | S | 8.8E-67 | 211.6 | _KGS(ph)ITEYTAAEEK_ | 0.66 | 21 |

TABLE 1-continued

Supplementary Table 1:
Phosphosites detected in the tumor sample using SUPER-SILAC mix. PEP-posterior error probability

| Gene Names | Position | Localization Prob | Number of Phosphosites | Amino Acids | PEP | PTM Score | Modified Sequence | Ratio H/L Tumor/SILAC | SEQ ID NO. |
|---|---|---|---|---|---|---|---|---|---|
| C2orf55 | 814 | 1.00 | 2 | T | 4.4E-04 | 67.2 | _GAEKSLPPAAT(ph)GPGADGQPAPPWITVT(ph)RQK_ | 534.95 | 22 |
| C2orf55 | 830 | 0.84 | 2 | T | 4.4E-04 | 67.2 | _GAEKSLPPAAT(ph)GPGADGQPAPPWITVT(ph)RQK_ | 534.95 | 22 |
| CANX | 618 | 1.00 | 1 | S | 6.3E-04 | 116.0 | _AEEDEILNRS(ph)PR_ | 0.51 | 23 |
| CANX | 599 | 0.98 | 1 | S | 2.5E-06 | 91.2 | _SDAEEDGGTVS(ph)QEEEDRKPK_ | 0.91 | 24 |
| CAV1 | 37 | 1.00 | 1 | S | 5.4E-07 | 145.2 | _AMADELS(ph)EK_ | 2.25 | 25 |
| CDC2L1 | 47 | 1.00 | 1 | S | 5.9E-05 | 147.5 | _RDS(ph)LEEGELR_ | 0.14 | 26 |
| CDS2 | 33 | 1.00 | 1 | S | 4.9E-64 | 210.0 | _VDGETAS(ph)DSESR_ | 0.77 | 27 |
| CSTF3 | 691 | 1.00 | 1 | S | 2.4E-04 | 60.5 | _RPNEDS(ph)DEDEEKGAVVPPVHDIYR_ | 1.27 | 28 |
| CTTN | 418 | 1.00 | 1 | S | 1.8E-06 | 124.2 | _LPSS(ph)PVYEDAASFK_ | 0.39 | 29 |
| CTTN | 417 | 0.91 | 1 | S | 1.8E-06 | 124.2 | _LPS(ph)SPVYEDAASFK_ | 0.55 | 30 |
| CXorf26 | 197 | 1.00 | 1 | S | 2.3E-29 | 172.8 | _GADS(ph)GEEKEEGINREDK_ | 0.77 | 31 |
| DDX21 | 121 | 1.00 | 1 | S | 2.2E-16 | 163.6 | _NEEPS(ph)EEEIDAPKPK_ | 0.04 | 32 |
| DKC1 | 494 | 0.87 | 1 | S | 5.6E-05 | 96.0 | _AGLESGAEPGDGDS(ph)DTTKK_ | 1.17 | 33 |
| DKC1 | 497 | 0.81 | 1 | T | 5.6E-05 | 96.0 | _AGLESGAEPGDGDSDTT(ph)KK_ | 0.42 | 34 |
| DNAJC5 | 10 | 0.97 | 1 | S | 2.9E-13 | 136.9 | _SLS(ph)TSGESLYHVLGLDK_ | 0.32 | 35 |
| DNAJC5 | 11 | 0.94 | 1 | T | 2.9E-13 | 136.9 | _SLST(ph)SGESLYHVLGLDK_ | 0.29 | 36 |
| EIF3CL | 39 | 1.00 | 1 | S | 1.4E-03 | 92.1 | _QPLLLS(ph)EDEEDTKR_ | 0.55 | 37 |
| EIF4G1 | 1186 | 1.00 | 1 | S | 1.2E-16 | 192.4 | _S(ph)FSKEVEER_ | 0.18 | 38 |
| EIF4G1 | 1188 | 1.00 | 1 | S | 1.2E-16 | 192.4 | _SFS(ph)KEVEER_ | 0.31 | 39 |
| EPPK1 | 2716 | 0.99 | 1 | S | 4.0E-04 | 79.4 | _QVS(ph)ASELHTSGILGPETLR_ | 4.36 | 40 |
| FLNA | 2144 | 1.00 | 1 | S | 3.9E-13 | 135.5 | _RAPS(ph)VANVGSHCDLSLK_ | 1.98 | 41 |
| G3BP1 | 232 | 0.89 | 1 | S | 2.7E-82 | 210.0 | _SSS(ph)PAPADIAQTVQEDLR_ | 0.67 | 42 |
| HDGF | 165 | 1.00 | 1 | S | 2.0E-47 | 197.2 | _RAGDLLEDS(ph)PK_ | 0.63 | 43 |
| HDGF | 133 | 0.89 | 1 | S | 8.4E-07 | 100.5 | _GNAEGSS(ph)DEEGKLVIDEPAK_ | 1.40 | 44 |
| HEATR5A | 1771 | 0.70 | 2 | S | 1.3E-03 | 72.6 | _LPGGQLSS(ph)TVAASLQALK(ac)GILS(ph)SPMAR_ | 0.01 | 45 |
| HEATR5A | 1785 | 0.50 | 2 | S | 1.3E-03 | 72.6 | _LPGGQLSS(ph)TVAASLQALK(ac)GILS(ph)SPMAR_ | 0.01 | 45 |
| HMGCS1 | 18 | 1.00 | 1 | S | 2.1E-17 | 139.3 | _(ac)SETAPAETATPAPVEKS(ph)PAK_ | 2.44 | 46 |
| HMGCS1 | 495 | .99 | 1 | S | 5.9E-14 | 86.8 | _RPTPNDDTLDEGVGLVHSNIATEHIPS(ph)PAK_ | 0.39 | 47 |
| HN1 | 87 | 1.00 | 1 | S | 8.3E-95 | 230.2 | _RNS(ph)SEASSGDFLDLK_ | 0.30 | 48 |
| HN1 | 88 | 0.89 | 1 | S | 8.3E-95 | 230.2 | _RNSS(ph)EASSGDFLDLK_ | 0.76 | 49 |
| HNRNPA3 | 358 | 0.97 | 1 | S | 1.6E-180 | 263.7 | _SSGS(ph)PYGGGYGSGGGSGGYGSR_ | 0.50 | 50 |
| HNRNPC | 233 | 1.00 | 1 | S | 9.7E-22 | 160.0 | _NDKS(ph)EEEQSSSSVK_ | 1.28 | 51 |

TABLE 1-continued

Supplementary Table 1:
Phosphosites detected in the tumor sample using SUPER-SILAC mix. PEP-posterior error probability

| Gene Names | Position | Locali-zation Prob | Number of Phospho-sites | Amino Acids | PEP | PTM Score | Modified Sequence | Ratio H/L Tumor/ SILAC | SEQ ID NO. |
|---|---|---|---|---|---|---|---|---|---|
| HNRNPD | 83 | 1.00 | 1 | S | 9.4E-22 | 152.1 | _NEEDEGHSNSS(ph)PR_ | 1.16 | 52 |
| HNRNPK | 284 | 1.00 | 1 | S | 2.0E-06 | 160.1 | _RDYDDMS(ph)PR_ | 0.64 | 53 |
| HNRNPUL2 | 161 | 1.00 | 1 | S | 1.4E-08 | 131.8 | _S(ph)GDETPGSEVPGDK_ | 1.67 | 54 |
| HNRNPUL2 | 185 | 0.99 | 1 | S | 6.8E-08 | 92.3 | _AAEEQGDDQDS(ph)EKSKPAGSDGER_ | 2.05 | 55 |
| HSP90AB1 | 226 | 1.00 | 1 | S | 2.6E-04 | 111.2 | _EKEIS(ph)DDEAEEEKGEK_ | 0.62 | 56 |
| HSP90AB1 | 255 | 1.00 | 1 | S | 1.4E-46 | 183.3 | _IEDVGS(ph)DEEDDSGKDKK_ | 0.61 | 57 |
| HTATSF1 | 616 | 1.00 | 1 | S | 5.4E-07 | 145.2 | _VLDEEGS(ph)ER_ | 0.63 | 58 |
| ILF3 | 382 | 0.95 | 1 | S | 4.0E-11 | 139.1 | _RPM(ox)EEDGEEKS(ph)PSK_ | 1.40 | 59 |
| ILF3 | 384 | 0.92 | 1 | S | 4.0E-11 | 139.1 | _RPRMEEDGEEKSPS(ph)K_ | 1.91 | 60 |
| KNG1 | 332 | 0.98 | 1 | S | 8.1E-04 | 100.5 | _ETTCSKES(ph)NEELTESCETKK_ | 98.96 | 61 |
| KRT14 | 435 | 1.00 | 1 | S | 3.8E-122 | 263.7 | _LLEGEDAHLSSSQFSSGS(ph)QSSR_ | 0.01 | 62 |
| KRT5 | 64 | 1.00 | 1 | S | 1.1E-06 | 143.5 | _S(ph)LYNLGGSK_ | 0.07 | 63 |
| KRT7 | 38 | 0.92 | 1 | S | 1.1E-04 | 121.7 | _PGGLGSSS(ph)LYGLGASR_ | 0.23 | 64 |
| LUC7L | 363 | 1.00 | 1 | S | 5.3E-04 | 133.8 | _RS(ph)EEKEAGEI_ | 0.27 | 65 |
| LYN | 104 | 1.00 | 1 | S | 3.7E-16 | 156.6 | _GKDSLS(ph)DDGVDLK_ | 0.78 | 66 |
| MAP4 | 636 | 1.00 | 1 | S | 2.3E-29 | 172.8 | _KCS(ph)LPAEEDSVLEK_ | 0.44 | 67 |
| MAP4 | 280 | 1.00 | 1 | S | 4.4E-39 | 186.0 | _DMES(ph)PTKLDVTLAK_ | 0.82 | 68 |
| MATR3 | 188 | 1.00 | 1 | S | 1.1E-03 | 142.7 | _RDS(ph)FDDR_ | 0.70 | 69 |
| MATR3 | 598 | 0.99 | 2 | S | 1.9E-03 | 94.3 | _SYS(ph)PDGKES(ph)PSDKK_ | 1.09 | 70 |
| MATR3 | 606 | 0.97 | 2 | S | 1.9E-03 | 94.3 | _SYS(ph)PDGKESPS(ph)DKK_ | 1.46 | 71 |
| MATR3 | 604 | 0.92 | 2 | S | 1.9E-03 | 94.3 | _S(ph)YSPDGKES(ph)PSDKK_ | 1.62 | 72 |
| MKI67 | 308 | 1.00 | 1 | S | 4.0E-14 | 119.2 | _SGGSGHAVAEPAS(ph)PEQELDQNK_ | 0.11 | 73 |
| MTDH | 426 | 1.00 | 1 | S | 8.8E-04 | 82.1 | _SQEPIPDDQKVS(ph)DDDKEK_ | 1.21 | 74 |
| MYH9 | 1943 | 1.00 | 1 | S | 1.9E-140 | 258.6 | _KGAGDGS(ph)DEEVDGKADGAEAK_ | 2.25 | 75 |
| MYO18A | 2014 | 0.97 | 1 | S | 1.8E-03 | 73.6 | _S(ph)LAPDRSDDEHDPLDNTSRPR_ | 0.83 | 76 |
| MYO18A | 2020 | 0.87 | 1 | S | 1.8E-03 | 73.6 | _SLAPDRS(ph)DDEHDPLDNTSRPR_ | 1.37 | 77 |
| NCAPG | 674 | 1.00 | 1 | S | 5.6E-04 | 101.1 | _TLHCEGTEINS(ph)DDEQESK_ | 0.65 | 78 |
| NCL | 67 | 0.95 | 1 | S | 8.6E-04 | 130.9 | _VVVS(ph)PTKK_ | 1.32 | 79 |
| NOP58 | 502 | 1.00 | 1 | S | 2.1E-18 | 125.1 | _HIKEEPLS(ph)EEEPCTSTAIASPEK_ | 0.74 | 80 |
| NUCKS1 | 214 | 1.00 | 1 | S | 3.7E-16 | 156.6 | _EEDEEPES(ph)PPEKK_ | 1.81 | 81 |
| NUCKS1 | 75 | 0.98 | 1 | S | 8.4E-07 | 100.5 | _DDSHS(ph)AEDSEDEKEDHKNVR_ | 0.74 | 82 |
| NUCKS1 | 79 | 0.96 | 1 | S | 8.4E-07 | 100.5 | _DDSHSAEDS(ph)EDEKEDHKNVR_ | 1.73 | 83 |
| NUCKS1 | 54 | 0.95 | 1 | S | 8.1E-04 | 83.6 | _SGKNS(ph)QEDSEDSEDKDVK_ | 6.37 | 84 |
| OGFR | 298 | 1.00 | 1 | S | 2.3E-04 | 82.3 | _KVEEEGS(ph)PGDPDHEASTQGR_ | 0.84 | 85 |

TABLE 1-continued

Supplementary Table 1:
Phosphosites detected in the tumor sample using SUPER-SILAC mix. PEP-posterior error probability

| Gene Names | Position | Locali- zation Prob | Number of Phospho- sites | Amino Acids | PEP | PTM Score | Modified Sequence | Ratio H/L Tumor/ SILAC | SEQ ID NO. |
|---|---|---|---|---|---|---|---|---|---|
| P12763* | 323 | 0.99 | 1 | S | 2.8E-93 | 247.5 | _HTFSGVASVES(ph)SSGEAFHVGK_ | 59.18 | 86 |
| P12763* | 325 | 0.87 | 1 | S | 2.8E-93 | 247.5 | _HTFSGVASVESSS(ph)GEAFHVGK_ | 14.46 | 87 |
| PALLD | 893 | 1.00 | 1 | S | 1.1E-76 | 225.2 | _IAS(ph)DEEIQGTK_ | 1.25 | 88 |
| PALLD | 1121 | 1.00 | 1 | S | 1.6E-92 | 228.2 | _SRDS(ph)GDENEPIQER_ | 13.60 | 89 |
| PCBP1 | 189 | 0.89 | 1 | S | 3.7E-06 | 105.0 | _VMTIPYQPMPAS(ph)SPVICAGGQ DR_ | 0.36 | 90 |
| PDCD4 | 457 | 1.00 | 1 | S | 8.6E-04 | 130.9 | _FVS(ph)EGDGGR_ | 0.93 | 91 |
| PDHA1 | 331 | 1.00 | 1 | S | 1.1E-10 | 135.7 | _YHGHS(ph)MSDPGVSYR_ | 0.74 | 92 |
| PDHA1 | 327 | 0.94 | 1 | Y | 1.1E-10 | 135.7 | _Y(ph)HGHSMSDPGVSYR_ | 1.59 | 93 |
| PDLIM4 | 112 | 0.99 | 1 | S | 2.5E-03 | 92.1 | _IHIDPEIQDGS(ph)PTTSR_ | 25.81 | 94 |
| PDS5B | 1283 | 1.00 | 1 | S | 9.9E-04 | 91.4 | _LKEDILENEDEQNS(ph)PPKK_ | 3.77 | 95 |
| PNN | 443 | 0.97 | 1 | S | 9.5E-04 | 106.8 | _SLS(ph)PGKENVSALDMEK_ | 0.23 | 96 |
| PPAN | 359 | 1.00 | 1 | S | 1.8E-06 | 124.2 | _VGGS(ph)DEEASGIPSR_ | 0.17 | 97 |
| PRCC | 157 | 0.89 | 1 | S | 2.5E-06 | 91.2 | _IAAPELHKGDS(ph)DSEEDEPTK_ | 6.32 | 98 |
| PRPF38B | 529 | 0.98 | 1 | S | 1.5E-05 | 137.0 | _SQS(ph)IEQESQEK_ | 0.27 | 99 |
| PRPF4B | 849 | 0.98 | 1 | Y | 9.83-10 | 100.4 | _LCDFGSASHVADNDITPY(ph)LVSR_ | 2.07 | 100 |
| PRPSAP2 | 227 | 0.99 | 1 | S | 4.0E-04 | 56.9 | _LGIAVIHGEAQDAESDLVDGRHS(ph)PPMVR_ | 0.85 | 101 |
| PUM1 | 745 | 1.00 | 1 | S | 2.7E-14 | 153.3 | _RDS(ph)LTGSSDLYK_ | 0.09 | 102 |
| REPS1 | 272 | 1.00 | 1 | S | 3.8E-04 | 124.2 | _RQS(ph)SSYDDPWK_ | 0.80 | 103 |
| SART1 | 448 | 1.00 | 1 | S | 9.9E-13 | 113.3 | _RVS(ph)EVEEEKEPVPQPLPSDDTR_ | 0.67 | 104 |
| SCRIB | 504 | 0.99 | 1 | S | 1.8E-14 | 145.5 | _RSEACPCQPDSGS(ph)PLPAEEEK_ | 0.09 | 105 |
| SET | 50 | 1.00 | 1 | S | 1.5E-05 | 137.0 | _LNEQAS(ph)EEILK_ | 0.08 | 106 |
| SIN3A | 1112 | 1.00 | 1 | S | 1.6E-45 | 195.0 | _YMNSDTTS(ph)PELR_ | 3.00 | 107 |
| SIN3A | 1111 | 0.95 | 1 | T | 1.6E-45 | 195.0 | _YMNSDDT(ph)SPELR_ | 0.37 | 108 |
| SLC9A3R1 | 288 | 0.94 | 1 | S | 8.3E-187 | 277.9 | _S(ph)ASSDTSEELNSQDSPPK_ | 0.17 | 109 |
| SLC9A3R1 | 290 | 0.93 | 1 | S | 8.3E-187 | 277.9 | _SAS(ph)SDTSEELNSQDSPPK_ | 3.98 | 110 |
| SON | 1556 | 0.99 | 1 | S | 4.0E-14 | 119.2 | _EMEHNTVCAAGTS(ph)PVGEIGEEK_ | 1.19 | 111 |
| SRRM2 | 876 | 1.00 | 1 | S | 1.6E-45 | 195.0 | _SCFESS(ph)PDPELK_ | 0.95 | 112 |
| SRRT | 544 | 1.00 | 1 | T | 2.3E-16 | 106.7 | _TQLWASEPGT(ph)PPLPTSLPSQNPILK_ | 1.62 | 113 |
| SSB | 336 | 1.00 | 1 | S | 2.1E-03 | 74.6 | _FAS(ph)DDEHDEHDENGATGPVK_ | 0.81 | 114 |
| SSH3 | 87 | 0.82 | 1 | S | 8.6E-06 | 63.7 | _APSEEELHGDQTDFGQGSQS(ph)PQKQEEQR_ | 4.05 | 115 |
| SUMO1P3 | 2 | 0.98 | 1 | S | 2.1E-21 | 155.4 | _(ac)S(ph)DQEAKPSTEDLGDKK_ | 0.60 | 116 |
| SUMO1P3 | 10 | 0.88 | 1 | T | 2.1E-21 | 155.4 | _(ac)SDQEAKPST(ph)EDLGDKK_ | 1.31 | 117 |
| SYF2 | 230 | 0.90 | 1 | T | 2.2E-05 | 134.8 | _YT(ph)AEIKQNLER_ | 0.05 | 118 |

TABLE 1-continued

Supplementary Table 1:
Phosphosites detected in the tumor sample using SUPER-SILAC mix. PEP-posterior error probability

| Gene Names | Position | Locali-zation Prob | Number of Phospho-sites | Amino Acids | PEP | PTM Score | Modified Sequence | Ratio H/L Tumor/ SILAC | SEQ ID NO. |
|---|---|---|---|---|---|---|---|---|---|
| TJP2 | 275 | 1.00 | 1 | S | 2.4E-03 | 120.7 | _GRS(ph)IDQDYER_ | 0.10 | 119 |
| TJP2 | 199 | 0.99 | 1 | S | 2.3E-03 | 117.4 | _S(ph)RSWEDSPER_ | 0.91 | 120 |
| TMPO | 74 | 1.00 | 1 | T | 1.2E-16 | 137.3 | _GPPDFSSDEEREPT(ph)PVLGSGAAAAGR_ | 6.98 | 121 |
| TOP2A | 1474 | 0.73 | 1 | S | 4.5E-04 | 84.5 | _GSVPLSSS(ph)PPATHFPDETEITNPVPK_ | 0.14 | 122 |
| TPI | 58 | 1.00 | 1 | S | 1.1E-121 | 244.8 | _KQS(ph)LGELIGTLNAAK_ | 0.19 | 123 |
| YBX1 | 165 | 1.00 | 1 | S | 2.3E-29 | 172.8 | _NYQQNYQNS(ph)ESGEK_ | 0.09 | 124 |
| YTHDC1 | 424 | 0.89 | 1 | S | 2.3E-03 | 56.2 | _LSSESHHGGS(ph)PIHWVLPAGMSAK_ | 2.08 | 125 |
| ZMYND8 | 695 | 1.00 | 1 | S | 8.5E-04 | 88.2 | _DKAS(ph)PEPEKDFSEK_ | 0.93 | 126 |
| ZNF768 | 125 | 1.00 | 1 | S | 2.2E-04 | 124.2 | _YEPQS(ph)PGYEPR_ | 0.29 | 127 |

TABLE 2

Supplementary Table 2: Tumor kinases quantified using SUPER-SILAC mix.

| Protein Names | Gene Names | Mean Ratio | Coeff. Of Variation* | SEQ ID NO. |
|---|---|---|---|---|
| Beta-adrenergic receptor kinase 1 | ADRBK1 | 2.24 | 0.095 | 128 |
| A-kinase anchor protein 13 | AKAP13 | 1.95 | 0.27 | 129 |
| RAC-alpha serine/threonine-protein kinase | AKT1 | 1 | 0.063 | 130 |
| RAC-beta serine/threonine-protein kinase | AKT2 | 1.85 | 0.044 | 131 |
| Tyrosine-protein kinase BAZ1B | BAZ1B | 1.4 | 0.084 | 132 |
| Calcium/calmodulin-dependent protein kinase type II delta chain | CAMK2D | 0.91 | 0.325 | 133 |
| Peripheral plasma membrane protein CASK | CASK | 2.05 | 0.021 | 134 |
| Cell division control protein 2 homolog | CDC2 | 1.47 | 0.039 | 135 |
| Serine/threonine-protein kinase MRCK alpha | CDC42BPA | 0.5 | 0.257 | 136 |
| Serine/threonine-protein kinase MRCK beta | CDC42BPB | 0.96 | 0.055 | 137 |
| Cell division protein kinase 2 | CDK2 | 1.33 | 0.123 | 138 |
| Cell division protein kinase 4 | CDK4 | 1.11 | 0.045 | 139 |
| Collagen type IV alpha-3-binding protein | COL4A3BP | 1.3 | 0.301 | 140 |
| Crk-like protein | CRKL | 1.26 | 0.087 | 141 |
| Cell division cyle 2-related protein kinase 7 | CRKRS | 1 | 0.136 | 142 |
| Tyrosine-protein kinase CSK | CSK | 1.8 | 0.05 | 143 |
| Casein kinase I isoform alpha | CSNK1A1 | 0.49 | 0.029 | 144 |
| Casein kinase II subunit alpha | CSNK2A1 | 0.83 | 0.038 | 145 |
| Casein kinase II subunit alpha' | CSNK2A2 | 0.88 | 0.032 | 146 |
| Casein kinase 2 beta polypeptide | CSNK2B | 0.92 | 0.092 | 147 |
| Discoidin domain receptor family | DDR1 | 0.45 | 0.249 | 148 |
| Epidermal growth factor receptor | EGFR | 0.12 | 0.064 | 149 |
| Interferon-induced, double-stranded RNA-activated protein kinase | EIF2AK2 | 0.62 | 0.037 | 150 |
| Ephrin type-A receptor 2 | EPHA2 | 0.07 | 0.071 | 151 |
| Ephrin type-B receptor 3 | EPHB3 | 2.07 | 0.064 | 152 |
| Receptor tyrosine-protein kinase erbB-2 | ERBB2 | 0.08 | 0.071 | 153 |
| Exosome component 10 | EXOSC10 | 1.05 | 0.049 | 154 |
| Focal adhesion kinase 1 | FAK1 | 1.02 | 0.051 | 155 |
| FKBP12-rapamycin complex-associated protein | FRAP1 | 0.79 | 0.047 | 156 |
| Cyclin G-associated kinase | GAK | 1.48 | 0.036 | 157 |
| Golgin subfamily A member 5 | GOLGA5 | 0.53 | 0.082 | 158 |
| Glycogen synthase kinase-3 beta | GSK3B | 0.86 | 0.038 | 159 |
| Insulin-like growth factor 2 receptor | IGF2R | 0.71 | 0.03 | 160 |
| Integrin-linked protein kinase | ILK | 2.78 | 0.038 | 161 |
| Legumain | LGMN | 2.20 | 0.076 | 162 |
| LYN protein | LYN | 2.87 | 0.058 | 163 |
| Dual specificity mitogen-activated protein kinase kinase 1 | MAP2K1 | 0.61 | 0.026 | 164 |

TABLE 2-continued

Supplementary Table 2: Tumor kinases quantified using SUPER-SILAC mix.

| Protein Names | Gene Names | Mean Ratio | Coeff. Of Variation* | SEQ ID NO. |
|---|---|---|---|---|
| Dual specificity mitogen-activated protein kinase kinase 2 | MAP2K2 | 0.74 | 0.01 | 165 |
| Dual specificity mitogen-activated protein kinase kinase 4 | MAP2K4 | 1.43 | 0.062 | 166 |
| Mitogen-activated protein kinase kinase kinase 15 | MAP3K15 | 15.15 | 0.769 | 167 |
| Mitogen-activated protein kinase kinase kinase 4 | MAP3K4 | 1.32 | 0.097 | 168 |
| Mitogen-activated protein kinase kinase kinase 3 | MAP4K3 | 1.26 | 0.06 | 169 |
| Mitogen-activated protein kinase 1 | MAPK1 | 1.26 | 0.044 | 170 |
| Mitogen-activated protein kinase 14 | MAPK14 | 1.28 | 0.106 | 171 |
| Mitogen-activated protein kinase 3 | MAPK3 | 1.73 | 0.022 | 172 |
| Serine/threonine-protein kinase MARK1 | MARK1 | 0.64 | 0.071 | 173 |
| Mitogen-activated protiein kinase kinase kinase MLT | MLTK | 1.2 | 0.092 | 174 |
| Myosin light chain kinase | MYLK | 7.7 | 0.35 | 175 |
| Serine/threonine-protein kinase Nek7 | NEK7 | 2.79 | 0.049 | 176 |
| Serine/threonine-protein kinase Nek9 | NEK9 | 1.65 | 0.035 | 177 |
| Nuclear receptor-binding protein | NRBP1 | 0.71 | 0.052 | 178 |
| Nuclear pore glycoprotein p62 | NUP62 | 1.33 | 0.089 | 179 |
| Serine/threonine-protein kinase OSR1 | OXSR1 | 1.68 | 0.031 | 180 |
| Serine/threonine-protein kinase PAK1 | PAK1 | 1.46 | 0.043 | 181 |
| Serine/threonine-protein kinase PAK2 | PAK2 | 0.64 | 0.021 | 182 |
| Beta-type platelet-derived growth factor receptor | PDGFRB | 9.99 | 0.306 | 183 |
| 3-phosphoinositide-dependent protein kinase 1 | PDPK1 | 1.08 | 0.047 | 184 |
| Serine/threonine-protein kinase N2 | PKN2 | 0.82 | 0.124 | 185 |
| 5'-AMP-activated protein kinase catalytic subunit alpha-1 | PRKAA1 | 1.22 | 0.052 | 186 |
| cAMP-dependent protein kinase catalytic subunit alpha | PRKACA | 1.35 | 0.098 | 187 |
| cAMP-dependent protein kinase catalytic subunit beta | PRKACB | 1.18 | 0.12 | 188 |
| 5'-AMP-activated protein kinase subunit gamma-1 | PRKAG1 | 1.54 | 0.063 | 189 |
| Protein kinase C delta type | PRKCD | 1.06 | 0.243 | 190 |
| Protein kinase C iota type | PRKCI | 0.4 | 0.064 | 191 |
| Serine/threonine-protein kinase D2 | PRKD2 | 1.34 | 0.199 | 192 |
| DNA-dependent protein kinase catalytic subunit | PRKDC | 1.25 | 0.009 | 193 |
| Serine/threonine-protein kinase PRP4 homolog | PRPF4B | 1.75 | 0.126 | 194 |
| Tyrosine-protein kinase-like 7 | PRK7 | 2.28 | 0.053 | 195 |
| Serine/threonine-protein kinase RIO2 | RIOK2 | 0.55 | 0.072 | 196 |
| Receptor-interacting serine/threonine-protein kinase 1 | RIPK1 | 1.3 | 0.095 | 197 |
| Rho-associated protein kinase 1 | ROCK1 | 1.14 | 0.038 | 198 |
| Rho-associated protein kinase 2 | ROCK2 | 1.2 | 0.032 | 199 |
| 90 kDa ribosomal protein S6 kinase 1 | RPS6KA1 | 0.94 | 0.070 | 200 |
| Ribosomal protein S6 kinase alpha-5 | RPS6KA5 | 3.18 | 0.198 | 201 |
| Ribosomal protein S6 kinase beta-1 | RPS6KB1 | 0.21 | 0.128 | 202 |
| N-terminal kinase-like protein | SCYL1 | 0.67 | 0.111 | 203 |
| STE20-like serine/threonine-protein kinase | SLK | 0.86 | 0.026 | 204 |
| Serine/threonine-protein kinase SRPK1 | SRPK1 | 0.63 | 0.023 | 205 |
| Serine/threonine-protein kinase SRPK2 | SRPK2 | 0.78 | 0.06 | 206 |
| Serine/threonine-protein kinase 10 | STK10 | 0.73 | 0.049 | 207 |
| Serine/threonine-protein kinase 24 | STK24 | 0.059 | 0.041 | 208 |
| Serine/threonine-protein kinase 3 | STK3 | 0.88 | 0.042 | 209 |
| Serine/threonine-protein kinase 38 | STK38 | 0.87 | 0.041 | 210 |
| STE20/SPS1-related proline-alanine-rich protein kinase | STK39 | 0.90 | 0.106 | 211 |
| Tyrosine-protein kinase SYK | SYK | 2.93 | 0.12 | 212 |
| Serine/threonine-protein kinase TAO3 | TAOK3 | 1.1 | 0.066 | 213 |
| Serine/threonine-protein kinase TBK1 | TBK1 | 1.43 | 0.117 | 214 |
| Transforming growth factor beta regulator 4 | TBRG4 | 0.39 | 0.041 | 215 |
| TRK-fused gene protein | TFG | 0.75 | 0.05 | 216 |
| TP53-regulating kinase | TP53RK | 1.46 | 0.062 | 217 |
| Triple functional domain protein | TRIO | 1.17 | 0.03 | 218 |
| Titin | TTN | 1.14 | 0.133 | 219 |
| Twinfilin-1 | TWF1 | 1.08 | 0.064 | 220 |
| Serine/threonine-protein kinase VRK1 | VRK1 | 1.24 | 0.029 | 221 |
| Serine/threonine-protein kinase WNK1 | WNK1 | 0.97 | 0.039 | 222 |
| Proto-oncogene tyrosine-protein kinase Yes | YES1 | 1.88 | 0.106 | 223 |

*kinases with quantitative ratios in at least three analyses from five replicate analyses

TABLE 3

Supplementary Table 3: Tumor proteins selected out of a list of chemosensitivity related genes. Proteins were quantified using SUPER-SILAC mix.

| Protein Names | Gene Names | Mean Ratio | Coeff. Of Variation* | SEQ ID NO. |
|---|---|---|---|---|
| Multidrug resistance-associated protein 1 | ABCC1 | 0.5 | 0.026 | 224 |
| Aldose reductase | AKR1B1 | 0.4 | 0.018 | 225 |
| RAC-alpha serine/threonine-protein kinase | AKT1 | 1 | 0.063 | 130 |
| RAC-beta serine/threonine-protein kinase | AKT2 | 1.85 | 0.044 | 131 |
| DNA-(apurinic or apyrimidinic site) lyase | APEX1 | 1.49 | 0.024 | 226 |
| Bcl-2-like protein 1 | BCL2L1 | 0.55 | 0.076 | 227 |
| Caspase-3 | CASP3 | 1.49 | 0.027 | 228 |
| Caspase-8 | CASP8 | 1.04 | 0.059 | 229 |
| Cyclin-dependent kinase inhibitor 1B | CDKN1B | 3.18 | 0.032 | 230 |
| Cyclin-dependent kinase inhibitor 2A, isoforms 1/2/3 | CDKN2A | 1.36 | 0.08 | 231 |
| Dihydrofolate reductase | DHFR | 0.87 | 0.535 | 232 |
| Epidermal growth factor receptor | EGFR | 0.12 | 0.064 | 149 |
| Receptor tyrosine-protein kinase erbB-2 | ERBB2 | 0.08 | 0.071 | 153 |
| Glutamate-cysteine ligase catalytic subunit | GCLC | 0.7 | 0.018 | 233 |
| Lactoylglutathione lyase | GLO1 | 1 | 0.039 | 234 |
| Glutathione peroxidase 1 | GPX1 | 2.46 | 0.033 | 235 |
| Glutathione S-transferase P | GSTP1 | 0.3 | 0.03 | 236 |
| High mobility group protein B1 | HMGB1 | 2.43 | 0.013 | 237 |
| High mobility group protein B2 | HMGB2 | 4.48 | 0.046 | 238 |
| 78 kDa glucose-regulated protein | HSPA5 | 0.68 | 0.009 | 239 |
| Heat shock protein beta-1 | HSPB1 | 0.5 | 0.052 | 240 |
| Integrin beta-1 | ITGB1 | 0.6 | 0.012 | 241 |
| Kinesin-1 heavy chain | KIF5B | 0.71 | 0.014 | 242 |
| GTPase KRas | KRAS | 1.15 | 0.068 | 243 |
| Microtubule-associated protein 4 | MAP4 | 1.02 | 0.037 | 244 |
| cDNA FLJ56323, highly similar to Methylated-DNA-protein-cysteinemethyltransferase (EC 2.1.1.63) | MGMT | 1.36 | 0.315 | 245 |
| DNA mismatch repair protein Mlh1 | MLH1 | 2.14 | 0.657 | 246 |
| DNA mismatch repair protein Msh2 | MSH2 | 1.53 | 0.043 | 247 |
| Major vault protein | MVP | 1.17 | 0.018 | 248 |
| 26S proteasome non-ATPase regulatory subunit 14 | PSMD14 | 0.77 | 0.02 | 249 |
| Ribonucleoside-diphosphate reductase subunit M2 | RRM2 | 0.52 | 0.07 | 250 |
| Stathmin | STMN1 | 1.38 | 0.031 | 251 |
| DNA topoisomerase 1 | TOP1 | 0.55 | 0.018 | 252 |
| DNA topoisomerase 2 | TOP2A | 2.2 | 0.019 | 253 |
| DNA topoisomerase 2-beta | TOP2B | 2.25 | 0.027 | 254 |
| Tubulin beta chain | TUBB | 1.05 | 0.012 | 255 |
| Thymidylate synthase | TYMS | 0.64 | 0.069 | 256 |
| Baculoviral IAP repeat-containing protein 4 | XIAP | 0.58 | 0.104 | 257 |

TABLE 4

Supplementary Table 4: Calculation of the cost of production of SUPER-SILAC mix. Price per experiment is based on the calculation that 1 experiment would require 50 µg of SILAC mix. Therefore 1 × 15 cm cell culture dish would suffice for approximately 60 experiments. For production of the mix, naturally 5 plates are needed, but then a single experiment would require only 10 µg of proteins. Exact prices depend on manufacturer decision.

| | Stock Price | Price per experiment |
|---|---|---|
| Medium | 40 € per 0.5 lit | 0.13 € |
| Serum | 25 € per 0.5 lit medium | 0.08 € |
| Amino Acids | 50 € per 0.5 lit medium | 0.17 € |
| Total medium price | 115 € per 0.5 lit | 0.38 € |

TABLE 5

Cell lines used for SUPER-SILAC mix for astrocytoma/glioblastoma. PE-pleural effusion.

| Cell line | Tumor type | Tumor source | Grade |
|---|---|---|---|
| 1321N1 | Astrocytoma | Primary | — |
| CCF-STTG1 | Anaplastic astrocytoma | Primary | IV |
| U87MG | Glioblastoma-astrocytoma | Primary | IV |
| U118MG | Glioblastoma-astrocytoma | Primary | IV |
| U373MG | Glioblastoma-astrocytoma | Primary | III |

TABLE 6

| Protein | Position | Phosphopeptide | Fold increase | SEQ ID NO. |
|---|---|---|---|---|
| a | | | | |
| Baiap2I1/Irtks | T276 | DYDpTLSK | 5.5 | 258 |
| Frap1/mTOR | S2478/S2481 | AGTTVPEpSIHpSFIGDGLVKPEALNK | 3.7 | 259 |
| Irs2 | S303 | pSQSSGSSATHPISVPGAR | 2.8 | 260 |
| Irs2 | S362 | TApSEGDGGAAGGAGTAGGR | 2.7 | 261 |
| Irs2 | S573 | TYpSLTTPAR | 2.1 | 262 |
| Irs2 | S590 | QVPQPSSApSLDEYTLMR | 2.0 | 263 |
| Ncbp1 | S22 | KTpSDANETEDHLESLICK | 1.8 | 264 |
| Prka cb | T198 | TWpTLCGTPEYLAPEIILSK | 2.1 | 265 |
| Raf1 | S233 | YpSTPHAFTFNTSSPSSEGSLSQR | 2.1 | 266 |
| Rictor | S265 | HpSPDTAEGQLKEDR | 1.8 | 267 |
| Zfp36I1 | S54 | RHpSVTLPSSK | 1.6 | 268 |
| Zfp36I1 | S92 | SFpSEGGER | 1.4 | 269 |
| b | | | | |
| Acly | S455 | TApSFSESRADEVAPAKK | 2.1 | 270 |
| Akt1s1 | S184 | pSLPVSVPVWAFK | 2.5 | 271 |
| Akt1s1 | T247 | LNpTSDFQK | 3.6 | 272 |
| Gsk3β | S9 | TTpSFAESCKPVQQPSAFGSMK | 2.1 | 273 |
| Mapk14 | T180/Y182 | HTDDEMpTGpYVATR | Insulin only | 274 |
| Pd cd4 | S76 | GDpSVSDNGSEAVR | 2.7 | 275 |
| Pd cd4 | S457 | RFVpSEGDGGR | 1.8 | 276 |
| Pfkfb 2 | S469 | NpSFTPLSSSNTIR | 2.3 | 277 |
| Pfkfb2 | S486 | NYpSVGSRPLKPLSPLR | 3.0 | 278 |

SEQUENCE LISTING (278 sequences)

SEQ ID NO: 1 - protein, 13 aa, Homo sapiens
  MOD_RES (7)..(7): PHOSPHORYLATION
FLARYVSLPNQNK

SEQ ID NO: 2 - protein, 17 aa, Homo sapiens
  MOD_RES (11)..(11): PHOSPHORYLATION
SSSISEEKGDSDDEKPR

SEQ ID NO: 3 - protein, 10 aa, Homo sapiens
  MOD_RES (3)..(3): PHOSPHORYLATION
TTSPLEEEER

SEQ ID NO: 4 - protein, 18 aa, Homo sapiens
  MOD_RES (11)..(11): PHOSPHORYLATION
GLESRADSIGSGRAIPIK

SEQ ID NO: 5 - protein, 17 aa, Homo sapiens
  MOD_RES (3)..(3): PHOSPHORYLATION
LKSEDGVEGDLGETQSR

SEQ ID NO: 6 - protein, 14 aa, Homo sapiens
  MOD_RES (8)..(8): PHOSPHORYLATION
GHYEVTGSDDETGK

SEQ ID NO: 7 - protein, 14 aa, Homo sapiens
  MOD_RES (12)..(12): PHOSPHORYLATION
GHYEVTGSDDETGK

SEQ ID NO: 8 - protein, 12 aa, Homo sapiens
  MOD_RES (7)..(7): PHOSPHORYLATION
CDSSPDSAEDVR

SEQ ID NO: 9 - protein, 12 aa, Homo sapiens
  MOD_RES (1)..(1): PHOSPHORYLATION
SLPVSVPVWGFK

SEQ ID NO: 10 - protein, 13 aa, Homo sapiens
  MOD_RES (7)..(7): PHOSPHORYLATION
TCVADESAENCDK

SEQ ID NO: 11 - protein, 15 aa, Homo sapiens
  MOD_RES (2)..(2): PHOSPHORYLATION
LSLHEEEGSSGSEQK

SEQ ID NO: 12 - protein, 13 aa, Homo sapiens
  MOD_RES (4)..(4): PHOSPHORYLATION
HRPSEADEEELAR

SEQ ID NO: 13 - protein, 19 aa, Homo sapiens
  MOD_RES (1)..(1): PHOSPHORYLATION
SLPAGDALYLSFNPPQPSR

SEQ ID NO: 14 - protein, 21 aa, Homo sapiens
  MOD_RES (15)..(15): PHOSPHORYLATION
GMKDDKEEEEDGTGSPQLNNR

SEQ ID NO: 15 - protein, 19 aa, Homo sapiens
  MOD_RES (11)..(11): PHOSPHORYLATION
  MOD_RES (17)..(17): PHOSPHORYLATION
LPVVVLLTVLYESDLVFDK

SEQ ID NO: 16 - protein, 21 aa, Homo sapiens
  MOD_RES (12)..(12): PHOSPHORYLATION
RPTETNPVTSNSDEECNETVK

SEQ ID NO: 17 - protein, 25 aa, Homo sapiens
  MOD_RES (16)..(16): PHOSPHORYLATION
ELLVPQHTVQLVGGLSPLSSPSDTK

SEQ ID NO: 18 - protein, 14 aa, Homo sapiens
  MOD_RES (5)..(5): PHOSPHORYLATION
IGHHSTSDDSSAYR

SEQ ID NO: 19 - protein, 13 aa, Homo sapiens
  MOD_RES (10)..(10): PHOSPHORYLATION
KAEGEPQEESPLK

SEQ ID NO: 20 - protein, 13 aa, Homo sapiens
  MOD_RES (8)..(8): PHOSPHORYLATION
LKDLFDYSPPLHK

SEQ ID NO: 21 - protein, 13 aa, Homo sapiens
  MOD_RES (3)..(3): PHOSPHORYLATION
KGSITEYTAAEEK

SEQ ID NO: 22 - protein, 30 aa, Homo sapiens
  MOD_RES (11)..(11): PHOSPHORYLATION
  MOD_RES (27)..(27): PHOSPHORYLATION
GAEKSLPPAATGPGADGQPAPPWITVTRQK

SEQ ID NO: 23 - protein, 12 aa, Homo sapiens
  MOD_RES (10)..(10): PHOSPHORYLATION
AEEDEILNRSPR

SEQ ID NO: 24 - protein, 20 aa, Homo sapiens
  MOD_RES (11)..(11): PHOSPHORYLATION
SDAEEDGGTVSQEEEDRKPK

SEQ ID NO: 25 - protein, 9 aa, Homo sapiens
  MOD_RES (7)..(7): PHOSPHORYLATION
AMADELSEK

SEQ ID NO: 26 - protein, 10 aa, Homo sapiens
  MOD_RES (3)..(3): PHOSPHORYLATION
RDSLEEGELR

SEQ ID NO: 27 - protein, 12 aa, Homo sapiens
  MOD_RES (7)..(7): PHOSPHORYLATION
VDGETASDSESR

SEQ ID NO: 28 - protein, 24 aa, Homo sapiens
  MOD_RES (6)..(6): PHOSPHORYLATION
RPNEDSDEDEEKGAVVPPVHDIYR

SEQ ID NO: 29 - protein, 14 aa, Homo sapiens
  MOD_RES (4)..(4): PHOSPHORYLATION
LPSSPVYEDAASFK

SEQ ID NO: 30 - protein, 14 aa, Homo sapiens
  MOD_RES (3)..(3): PHOSPHORYLATION
LPSSPVYEDAASFK

SEQ ID NO: 31 - protein, 17 aa, Homo sapiens
  MOD_RES (4)..(4): PHOSPHORYLATION
GADSGEEKEEGINREDK

SEQ ID NO: 32 - protein, 15 aa, Homo sapiens
  MOD_RES (5)..(5): PHOSPHORYLATION
NEEPSEEEIDAPKPK

SEQ ID NO: 33 - protein, 19 aa, Homo sapiens
  MOD_RES (14)..(14): PHOSPHORYLATION
AGLESGAEPGDGDSDTTKK

SEQ ID NO: 34 - protein, 19 aa, Homo sapiens
  MOD_RES (17)..(17): PHOSPHORYLATION
AGLESGAEPGDGDSDTTKK

SEQ ID NO: 35 - protein, 17 aa, Homo sapiens
  MOD_RES (3)..(3): PHOSPHORYLATION
SLSTSGESLYHVLGLDK

SEQ ID NO: 36 - protein, 17 aa, Homo sapiens
  MOD_RES (4)..(4): PHOSPHORYLATION
SLSTSGESLYHVLGLDK

SEQ ID NO: 37 - protein, 14 aa, Homo sapiens
  MOD_RES (6)..(6): PHOSPHORYLATION
QPLLLSEDEEDTKR

SEQ ID NO: 38 - protein, 9 aa, Homo sapiens
  MOD_RES (1)..(1): PHOSPHORYLATION
SFSKEVEER

SEQ ID NO: 39 - protein, 9 aa, Homo sapiens
  MOD_RES (3)..(3): PHOSPHORYLATION
SFSKEVEER

SEQ ID NO: 40 - protein, 19 aa, Homo sapiens
  MOD_RES (3)..(3): PHOSPHORYLATION
QVSASELHTSGILGPETLR

SEQ ID NO: 41 - protein, 17 aa, Homo sapiens
  MOD_RES (4)..(4): PHOSPHORYLATION
RAPSVANVGSHCDLSLK

SEQ ID NO: 42 - protein, 18 aa, Homo sapiens
  MOD_RES (3)..(3): PHOSPHORYLATION
SSSPAPADIAQTVQEDLR

SEQ ID NO: 43 - protein, 11 aa, Homo sapiens
  MOD_RES (9)..(9): PHOSPHORYLATION
RAGDLLEDSPK

SEQ ID NO: 44 - protein, 20 aa, Homo sapiens
  MOD_RES (7)..(7): PHOSPHORYLATION
GNAEGSSDEEGKLVIDEPAK

SEQ ID NO: 45 - protein, 27 aa, Homo sapiens
  MOD_RES (8)..(8): PHOSPHORYLATION
  MOD_RES (18)..(18): ACETYLATION
  MOD_RES (22)..(22): PHOSPHORYLATION
LPGGQLSSTVAASLQALKGILSSPMAR

SEQ ID NO: 46 - protein, 20 aa, Homo sapiens
  MOD_RES (1)..(1): ACETYLATION
  MOD_RES (17)..(17): PHOSPHORYLATION
SETAPAETATPAPVEKSPAK

SEQ ID NO: 47 - protein, 30 aa, Homo sapiens
  MOD_RES (27)..(27): PHOSPHORYLATION
RPTPNDDTLDEGVGLVHSNIATEHIPSPAK

SEQ ID NO: 48 - protein, 15 aa, Homo sapiens
  MOD_RES (3)..(3): PHOSPHORYLATION
RNSSEASSGDFLDLK

SEQ ID NO: 49 - protein, 15 aa, Homo sapiens
  MOD_RES (4)..(4): PHOSPHORYLATION
RNSSEASSGDFLDLK

SEQ ID NO: 50 - protein, 22 aa, Homo sapiens
  MOD_RES (4)..(4): PHOSPHORYLATION
SSGSPYGGGYGSGGGSGGYGSR

SEQ ID NO: 51 - protein, 14 aa, Homo sapiens
  MOD_RES (4)..(4): PHOSPHORYLATION
NDKSEEEQSSSSVK

SEQ ID NO: 52 - protein, 13 aa, Homo sapiens
  MOD_RES (11)..(11): PHOSPHORYLATION
NEEDEGHSNSSPR

SEQ ID NO: 53 - protein, 9 aa, Homo sapiens
  MOD_RES (7)..(7): PHOSPHORYLATION
RDYDDMSPR

SEQ ID NO: 54 - protein, 14 aa, Homo sapiens
  MOD_RES (1)..(1): PHOSPHORYLATION
SGDETPGSEVPGDK

SEQ ID NO: 55 - protein, 23 aa, Homo sapiens
  MOD_RES (11)..(11): PHOSPHORYLATION
AAEEQGDDQDSEKSKPAGSDGER

SEQ ID NO: 56 - protein, 16 aa, Homo sapiens
  MOD_RES (5)..(5): PHOSPHORYLATION
EKEISDDEAEEEKGEK

SEQ ID NO: 57 - protein, 17 aa, Homo sapiens
  MOD_RES (6)..(6): PHOSPHORYLATION
IEDVGSDEEDDSGKDKK

SEQ ID NO: 58 - protein, 9 aa, Homo sapiens
  MOD_RES (7)..(7): PHOSPHORYLATION
VLDEEGSER

SEQ ID NO: 59 - protein, 14 aa, Homo sapiens
  MOD_RES (3)..(3): OXIDATION
  MOD_RES (11)..(11): PHOSPHORYLATION
RPMEEDGEEKSPSK

SEQ ID NO: 60 - protein, 14 aa, Homo sapiens
  MOD_RES (13)..(13): PHOSPHORYLATION
RPMEEDGEEKSPSK

SEQ ID NO: 61 - protein, 20 aa, Homo sapiens
  MOD_RES (8)..(8): PHOSPHORYLATION
ETTCSKESNEELTESCETKK

SEQ ID NO: 62 - protein, 22 aa, Homo sapiens
  MOD_RES (18)..(18): PHOSPHORYLATION
LLEGEDAHLSSSQFSSGSQSSR

SEQ ID NO: 63 - protein, 9 aa, Homo sapiens
  MOD_RES (1)..(1): PHOSPHORYLATION
SLYNLGGSK

SEQ ID NO: 64 - protein, 16 aa, Homo sapiens
  MOD_RES (8)..(8): PHOSPHORYLATION
PGGLGSSSLYGLGASR

SEQ ID NO: 65 - protein, 10 aa, Homo sapiens
  MOD_RES (2)..(2): PHOSPHORYLATION
RSEEKEAGEI

SEQ ID NO: 66 - protein, 13 aa, Homo sapiens
  MOD_RES (6)..(6): PHOSPHORYLATION
GKDSLSDDGVDLK

SEQ ID NO: 67 - protein, 14 aa, Homo sapiens
  MOD_RES (3)..(3): PHOSPHORYLATION
KCSLPAEEDSVLEK

SEQ ID NO: 68 - protein, 14 aa, Homo sapiens
  MOD_RES (4)..(4): PHOSPHORYLATION
DMESPTKLDVTLAK

SEQ ID NO: 69 - protein, 7 aa, Homo sapiens
  MOD_RES (3)..(3): PHOSPHORYLATION
RDSFDDR

SEQ ID NO: 70 - protein, 14 aa, Homo sapiens
  MOD_RES (3)..(3): PHOSPHORYLATION
  MOD_RES (9)..(9): PHOSPHORYLATION
SYSPDGKESPSDKK

SEQ ID NO: 71 - protein, 14 aa, Homo sapiens
  MOD_RES (3)..(3): PHOSPHORYLATION
  MOD_RES (11)..(11): PHOSPHORYLATION
SYSPDGKESPSDKK

SEQ ID NO: 72 - protein, 14 aa, Homo sapiens
  MOD_RES (1)..(1): PHOSPHORYLATION
  MOD_RES (9)..(9): PHOSPHORYLATION
SYSPDGKESPSDKK

SEQ ID NO: 73 - protein, 22 aa, Homo sapiens
  MOD_RES (13)..(13): PHOSPHORYLATION
SGGSGHAVAEPASPEQELDQNK

SEQ ID NO: 74 - protein, 18 aa, Homo sapiens
  MOD_RES (12)..(12): PHOSPHORYLATION
SQEPIPDDQKVSDDDKEK

SEQ ID NO: 75 - protein, 21 aa, Homo sapiens
  MOD_RES (7)..(7): PHOSPHORYLATION
KGAGDGSDEEVDGKADGAEAK

SEQ ID NO: 76 - protein, 21 aa, Homo sapiens
  MOD_RES (1)..(1): PHOSPHORYLATION
SLAPDRSDDEHDPLDNTSRPR

SEQ ID NO: 77 - protein, 21 aa, Homo sapiens
  MOD_RES (7)..(7): PHOSPHORYLATION
SLAPDRSDDEHDPLDNTSRPR

SEQ ID NO: 78 - protein, 18 aa, Homo sapiens
  MOD_RES (11)..(11): PHOSPHORYLATION
TLHCEGTEINSDDEQESK

SEQ ID NO: 79 - protein, 8 aa, Homo sapiens
  MOD_RES (4)..(4): PHOSPHORYLATION
VVVSPTKK

SEQ ID NO: 80 - protein, 23 aa, Homo sapiens
  MOD_RES (8)..(8): PHOSPHORYLATION
HIKEEPLSEEEPCTSTAIASPEK

SEQ ID NO: 81 - protein, 13 aa, Homo sapiens
  MOD_RES (8)..(8): PHOSPHORYLATION
EEDEEPESPPEKK

SEQ ID NO: 82 - protein, 20 aa, Homo sapiens
  MOD_RES (5)..(5): PHOSPHORYLATION
DDSHSAEDSEDEKEDHKNVR

SEQ ID NO: 83 - protein, 20 aa, Homo sapiens
  MOD_RES (9)..(9): PHOSPHORYLATION
DDSHSAEDSEDEKEDHKNVR

SEQ ID NO: 84 - protein, 18 aa, Homo sapiens
  MOD_RES (5)..(5): PHOSPHORYLATION
SGKNSQEDSEDSEDKDVK

SEQ ID NO: 85 - protein, 20 aa, Homo sapiens
  MOD_RES (7)..(7): PHOSPHORYLATION
KVEEEGSPGDPDHEASTQGR

SEQ ID NO: 86 - protein, 21 aa, Homo sapiens
  MOD_RES (11)..(11): PHOSPHORYLATION
HTFSGVASVESSSGEAFHVGK

SEQ ID NO: 87 - protein, 21 aa, Homo sapiens
  MOD_RES (13)..(13): PHOSPHORYLATION
HTFSGVASVESSSGEAFHVGK

SEQ ID NO: 88 - protein, 11 aa, Homo sapiens
  MOD_RES (3)..(3): PHOSPHORYLATION
IASDEEIQGTK

SEQ ID NO: 89 - protein, 14 aa, Homo sapiens
  MOD_RES (4)..(4): PHOSPHORYLATION
SRDSGDENEPIQER

SEQ ID NO: 90 - protein, 23 aa, Homo sapiens
  MOD_RES (12)..(12): PHOSPHORYLATION
VMTIPYQPMPASSPVICAGGQDR

SEQ ID NO: 91 - protein, 9 aa, Homo sapiens
  MOD_RES (3)..(3): PHOSPHORYLATION
FVSEGDGGR

SEQ ID NO: 92 - protein, 14 aa, Homo sapiens
  MOD_RES (5)..(5): PHOSPHORYLATION
YHGHSMSDPGVSYR

SEQ ID NO: 93 - protein, 14 aa, Homo sapiens
  MOD_RES (1)..(1): PHOSPHORYLATION
YHGHSMSDPGVSYR

SEQ ID NO: 94 - protein, 16 aa, Homo sapiens
  MOD_RES (11)..(11): PHOSPHORYLATION
IHIDPEIQDGSPTTSR

SEQ ID NO: 95 - protein, 18 aa, Homo sapiens
  MOD_RES (14)..(14): PHOSPHORYLATION
LKEDILENEDEQNSPPKK

SEQ ID NO: 96 - protein, 16 aa, Homo sapiens
  MOD_RES (3)..(3): PHOSPHORYLATION
SLSPGKENVSALDMEK

SEQ ID NO: 97 - protein, 14 aa, Homo sapiens
  MOD_RES (4)..(4): PHOSPHORYLATION
VGGSDEEASGIPSR

SEQ ID NO: 98 - protein, 20 aa, Homo sapiens
  MOD_RES (11)..(11): PHOSPHORYLATION
IAAPELHKGDSDSEEDEPTK

SEQ ID NO: 99 - protein, 11 aa, Homo sapiens
  MOD_RES (3)..(3): PHOSPHORYLATION
SQSIEQESQEK

SEQ ID NO: 100 - protein, 22 aa, Homo sapiens
  MOD_RES (18)..(18): PHOSPHORYLATION
LCDFGSASHVADNDITPYLVSR

SEQ ID NO: 101 - protein, 28 aa, Homo sapiens
  MOD_RES (23)..(23): PHOSPHORYLATION
LGIAVIHGEAQDAESDLVDGRHSPPMVR

SEQ ID NO: 102 - protein, 12 aa, Homo sapiens
  MOD_RES (3)..(3): PHOSPHORYLATION
RDSLTGSSDLYK

SEQ ID NO: 103 - protein, 11 aa, Homo sapiens
  MOD_RES (3)..(3): PHOSPHORYLATION
RQSSSYDDPWK

SEQ ID NO: 104 - protein, 22 aa, Homo sapiens
  MOD_RES (3)..(3): PHOSPHORYLATION
RVSEVEEEKEPVPQPLPSDDTR

SEQ ID NO: 105 - protein, 21 aa, Homo sapiens
  MOD_RES (13)..(13): PHOSPHORYLATION
RSEACPCQPDSGSPLPAEEEK

SEQ ID NO: 106 - protein, 11 aa, Homo sapiens
  MOD_RES (6)..(6): PHOSPHORYLATION
LNEQASEEILK

SEQ ID NO: 107 - protein, 12 aa, Homo sapiens
  MOD_RES (8)..(8): PHOSPHORYLATION
YMNSDTTSPELR

SEQ ID NO: 108 - protein, 12 aa, Homo sapiens
  MOD_RES (7)..(7): PHOSPHORYLATION
YMNSDTTSPELR

SEQ ID NO: 109 - protein, 18 aa, Homo sapiens
  MOD_RES (1)..(1): PHOSPHORYLATION
SASSDTSEELNSQDSPPK

SEQ ID NO: 110 - protein, 18 aa, Homo sapiens
  MOD_RES (3)..(3): PHOSPHORYLATION
SASSDTSEELNSQDSPPK

SEQ ID NO: 111 - protein, 22 aa, Homo sapiens
  MOD_RES (13)..(13): PHOSPHORYLATION
EMEHNTVCAAGTSPVGEIGEEK

SEQ ID NO: 112 - protein, 12 aa, Homo sapiens
  MOD_RES (6)..(6): PHOSPHORYLATION
SCFESSPDPELK

SEQ ID NO: 113 - protein, 25 aa, Homo sapiens
  MOD_RES (10)..(10): PHOSPHORYLATION
TQLWASEPGTPPLPTSLPSQNPILK

SEQ ID NO: 114 - protein, 20 aa, Homo sapiens
  MOD_RES (3)..(3): PHOSPHORYLATION
FASDDEHDEHDENGATGPVK

SEQ ID NO: 115 - protein, 28 aa, Homo sapiens
  MOD_RES (20)..(20): PHOSPHORYLATION
APSEEELHGDQTDFGQGSQSPQKQEEQR

SEQ ID NO: 116 - protein, 16 aa, Homo sapiens
  MOD_RES (1)..(1): PHOSPHORYLATION
  MOD_RES (1)..(1): ACETYLATION
SDQEAKPSTEDLGDKK

SEQ ID NO: 117 - protein, 16 aa, Homo sapiens
  MOD_RES (1)..(1): ACETYLATION
  MOD_RES (9)..(9): PHOSPHORYLATION
SDQEAKPSTEDLGDKK

SEQ ID NO: 118 - protein, 11 aa, Homo sapiens
  MOD_RES (2)..(2): PHOSPHORYLATION
YTAEIKQNLER

SEQ ID NO: 119 - protein, 10 aa, Homo sapiens
  MOD_RES (3)..(3): PHOSPHORYLATION
GRSIDQDYER

SEQ ID NO: 120 - protein, 10 aa, Homo sapiens
  MOD_RES (1)..(1): PHOSPHORYLATION
SRSWEDSPER

SEQ ID NO: 121 - protein, 26 aa, Homo sapiens
  MOD_RES (14)..(14): PHOSPHORYLATION
GPPDFSSDEEREPTPVLGSGAAAAGR

SEQ ID NO: 122 - protein, 26 aa, Homo sapiens
  MOD_RES (8)..(8)
GSVPLSSSPPATHFPDETEITNPVPK

SEQ ID NO: 123 - protein, 15 aa, Homo sapiens
  MOD_RES (3)..(3): PHOSPHORYLATION
KQSLGELIGTLNAAK

SEQ ID NO: 124 - protein, 14 aa, Homo sapiens
  MOD_RES (9)..(9): PHOSPHORYLATION
NYQQNYQNSESGEK

SEQ ID NO: 125 - protein, 23 aa, Homo sapiens
  MOD_RES (10)..(10): PHOSPHORYLATION
LSSESHHGGSPIHWVLPAGMSAK

SEQ ID NO: 126 - protein, 14 aa, Homo sapiens
  MOD_RES (4)..(4): PHOSPHORYLATION
DKASPEPEKDFSEK

SEQ ID NO: 127 - protein, 11 aa, Homo sapiens
  MOD_RES (5)..(5): PHOSPHORYLATION
YEPQSPGYEPR

SEQ ID NO: 128 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 129 - protein, 2817 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 130 - protein, 480 aa, Homo sapiens [sequence omitted]

SEQ ID NO: 131 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 132 - protein, 1483 aa, Homo sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 133 - protein, 478 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 134 - protein, 921 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 135 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 136 - protein, 1638 aa, Homo sapiens
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKLEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 137 - protein, 1711 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSCSPTHVTVYSEYGVDVFDVRTMEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 138 - protein, 298 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 139 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 140 - protein, 624 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 141 - protein, 303 aa, Homo sapiens
MSSARFDSSDRSAWYMGPVSRQEAQTRLQGQRHGMFLVRDSSTCPGDYVLSVSENSRVSHYIINSLPNRRFKIGDQEFDHLPALLEFYKIHYLDTTTLIEPAPRYPSPPMGSVSAPNLPTAEDNLEYVRTLYDFPGNDAEDLPFKKGEILVIIEKPEEQWWSARNKDGRVGMIPVPYVEKLVRSSPHGKHGNRNSNSYGIPEPAHAYAQPQTTTPLPAVSGSPGAAITPLPSTQNGPVFAKAIQKRVPCAYDKTALALEVGDIVKVTRMNINGQWEGEVNGRKGLFPFTHVKIFDPQNPDENE

SEQ ID NO: 142 - protein, 1490 aa, Homo sapiens
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAACPPHILPPEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 143 - protein, 450 aa, Homo sapiens
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 144 - protein, 365 aa, Homo sapiens
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKCLESPVGKRKRSMTVSTSQDPSFSGLNQLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 145 - protein, 391 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 146 - protein, 350 aa, Homo sapiens
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 147 - protein, 215 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 148 - protein, 913 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 149 - protein, 1210 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCKLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 150 - protein, 551 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 151 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 152 - protein, 998 aa, Homo sapiens
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 153 - protein, 1255 aa, Homo sapiens [sequence omitted]

SEQ ID NO: 154 - protein, 885 aa, Homo sapiens
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 155 - protein, 1052 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 156 - protein, 2342 aa, Homo sapiens
MTTQMKWSDKFMSLFNELVSETSQTQNDIITKKLHDFVLIVVRDLQGDGVSTFINEISSDLLAVLKKPEVNEKQHSAVINLIDFFITSDIDDSYPRTNAKDIIDCIMKSNNQNVIRNASVVLGKIIRLGPHDLVEKELDIANSYLEREPKVNGALIMQQIGLNNQVICFMNQNKIIESLLKGLYDRSINARTESQKALSILFNLFTSKESNNFDPEALYKQAVVYLKQTNSADLQHGALLLMVSLLRNCKEYMKPKYNEVLQMFLNVKEHKSMVIRKTVITSLPYFAQFDCDSFAPKNEEVIESFQKDRKSIADFAQFEHDELTRIKCEEPFNGIMNYLINSIKSFSDKSIVFTVIGDITREIKYEMYAFVEQVYAKMREIINSKEKKAEILNSIMYCMEQFIINIPVPRVFALIHKTFPTLLELGLSTPLVSLINQSCIIYNNPTYRLQTQKLLLDVICGVLLGKAFIPFGAPEHLKMFNRTIVPTVEGDDQIILALDTLHSFKFKHNIVPVVKECTMKYIDNETKKIRQEAAMLTQVLLPPIDTTKKFISTLDVTEVLEKLLDHGLSDPESEIRITIMKLLDERFDSFLAQSRNVQTLFVVLNDENLQVREYAIKIIGRLTHYNPAFVMPLFRKTIIRLLTQLQFINDLKTDEQVTLLMGQLVKSSGKLTKPYVEPLLNILLPKLEEAINKSHSTICIYILNIIGDLTTIGSDSSQYTQGLMKCIISVLQDKGNSQKKSLRRESALIALGKLVRSIGYVVQPYYDYPELLGLLIELASNERNQDIKIELIKVFGIIGAIDPYKYKLLTETEGANQNDDAETVESLLPISQAGTEEFYAMTVIGLLLNILRDNNLVSGHEQTVKTFVKVICYLNRKTLPYIPQILSLYLKLFKTCTISVRPALIKGLADIMYLIEKNIREYLPEIFTLIQECWDDTTVLPILQLVCEIAKVMHDEFKQYMPQMLSLIISELNKYVFEQNSLVFERIINSIVVLAEHIDFEDYLHLVIPSISDLVNEQVHWSIVLPTLKALYKFLQYVNAEEFISRLVLPLTRLLQNEILRDATMDVFCSIADGLGKRFLVYAPTIKFALNKYCPKYNNQRYESLTIKLQDTPDGLVLPIDENEGQNVTISEDLHAQVTSFNQDTTIKPNADINKVIAVWETYRQRRSKEDWFDWFRQIAMVFLKESPSQSLCYCHLLSTDHFPLARDLFNYAFLSMWQDSTDNSQRLTNCLIKVLENNNTPHEIIQTILNLCEFMEREGIKVPIKSLGDYSKKCNAYAKALHYKEQEFLENANINLIEELIGLNNQLQNYDAAAGLIEYTKQIKQVQNNDTELNQTWYEKLGRWQQALSIYERKLQEDINNPELLVGKLNCLHELGDWESLDTTAKTLWKIGDKKAISSARSLYAAALWYLDDWNEFDSIVSEMTESNFENDFFKSINCIHNEEFEEAKALINQQRIALDAELSSLVGEVYERSYSTIAKAQMLAELEEVIACKEGLYNQDAKSILKSAWSEKLINAKADVSIWQKLLKIRSFVLTETENSESWIKFTGLCYKSGKYKLAMKTLDRLAGINIENHLEELQPSKLRIGVQYLKLQWKGAKDLEEKKRLLNVLQNFADIIEERRGDDLNLKAVVCSKLGEWNLYIAQNSNAFNYETIPNILMYYHSTIQYDPESYKYWHHWALINFEIVSYIELDENYNEETLVDYLKVSIEAFVKSLILTKNNQTLQDTLRLLTILFKYGKYQEVEEAIVEGIRALPVDIWLHVIPQIIARIQSNVPAVKRVMTDLLTTIGKKHPQALVYPLTVASKSPSYDRRKTAMSVIEKIRTDSGHLVEQALLVSEELVRIAILWHEAWHEALEEASKEFYVNHSFDGMMAILQPLYDRLEKGGETQNERGFLQSYGKDLRDAFELCIRFKNKGKRASEKDHDIEGAWEIFFRIYKRIHKSINAVAVLELPHVSPRLMEAHDLDIAVPGTYKAQNVNNIIRIKSIAPVLNIIPSKQRPRKLTIVGSNGKEYKYCLKGHEDLRQDERVMQLFGLVNDLLASNSITSTHHLFITCYDVIPLSTMSGLIGWVPHSDTLHQLIKEYRESHNIPVDFEKRLINKICPRFDDLPFLQKVEVFEKVLAESSGMDLANILWLKSSSSESWIDRRTNFTRSVALMSMVGYILGLGDRHPSNLMLQRFTGNVVHIDFGDCFEVAIHREKFPEKIPFRLTRMIVNAMDVSGVEGTFRITCENVMAVLRENKDSLMAVLEAFVYDPLIVRLLGGKDVEDEDDKMNKESQGENYVMKSKAVSVMRRVLEKLTGKDFGNEELNVHDQVDRLIREATSNENLSQSYQGWCPYW

SEQ ID NO: 157 - protein, 1311 aa, Homo sapiens
MSLLQSALDFLAGPGSLGGASGRDQSDFVGQTVELGELRLRVRRVLAEGGFAFVYEAQDVGSGREYALKRLLSNEEEKNRAIIQEVCFMKKLSGHPNIVQFCSAASIGKEESDTGQAEFLLLTELCKGQLVEFLKKMESRGPLSCDTVLKIFYQTCRAVQHMHRQKPPIIHRDLKVENLLLSNQGTIKLCDFGSATTISHYPDYSWSAQRRALVEEEITRNTTPMYRTPEIIDLYSNFPIGEKQDIWALGCILYLLCFRQHPFEDGAKLRIVNGKYSIPPHDTQYTVFHSLIRAMLQVNPEERLSIAEVVHQLQEIAAARNVNPKSPITELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCFCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDVLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 158 - protein, 731 aa, Homo sapiens
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTLQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 159 - protein, 420 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 160 - protein, 2491 aa, Homo sapiens
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWRTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHAVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 161 - protein, 452 aa, Homo sapiens
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 162 - protein, 433 aa, Homo sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 163 - protein, 512 aa, Homo sapiens
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 164 - protein, 393 aa, Homo sapiens [sequence omitted]

SEQ ID NO: 165 - protein, 400 aa, Homo sapiens [sequence omitted]

SEQ ID NO: 166 - protein, 399 aa, Homo sapiens
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 167 - protein, 1313 aa, Homo sapiens
MESGGGNAPAGALGAASESPQCPPPPGVEGAAGPAEPDGAAEGAAGGSGEGESGGGPRRALRAVYVRSESSQGGAAGGPEAGARQCLLRACEAEGAHLTSVPFGELDFGETAVLDAFYDADVAVVDMSDVSRQPSLFYHLGVRESFDMANNVILYHDTDADTALSLKDMVTQKNTASSGNYYFIPYIVTPCADYFCCESDAQRRASEYMQPNWDNILGPLCMPLVDRFISLLKDIHVTSCVYYKETLLNDIRKAREKYQGEELAKELARIKLRMDNTEVLTSDIIINLLLSYRDIQDYDAMVKLVETLEMLPTCDLADQHNIKFHYAFALNRRNSTGDREKALQIMLQVLQSCDHPGPDMFCLCGRIYKDIFLDSDCKDDTSRDSAIEWYRKGFELQSSLYSGINLAVLLIVAGQQFETSLELRKIGVRLNSLLGRKGSLEKMNNYWDVGQFFSVSMLAHDVGKAVQAAERLFKLKPPVWYLRSLVQNLLLIRRFKKTIIEHSPRQERLNFWLDIIFEATNEVTNGLRFPVLVIEPTKVYQPSYVSINNEAEERTVSLWHVSPTEMKQMHEWNFTASSIKGISLSKFDERCCFLYVHDNSDDFQIYFSTEEQCSRFFSLVKEMITNTAGSTVELEGETDGDTLEYEYDHDANGERVVLGKGTYGIVYAGRDLSNQVRIAIKEIPERDSRYSQPLHEEIALHKYLKHRNIVQYLGSVSENGYIKIFMEQVPGGSLSALLRSKWGPMKEPTIKFYTKQILEGLKYLHENQIVHRDIKGDNVLVNTYSGVVKISDFGTSKRLAGVNPCTETFTGTLQYMAPEIIDQGPRGYGAPADIWSLGCTIIEMATSKPPFHELGEPQAAMFKVGMFKIHPEIPEALSAEARAFILSCFEPDPHKRATTAELLREGFLRQVNKGKKNRIAFKPSEGPRGVVLALPTQGEPMATSSSEHGSVSPDSDAQPDALFERTRAPRHHLGHLLSVPDESSALEDRGLASSPEDRDQGLFLLRKDSERRAILYKILWEEQNQVASNLQECVAQSSEELHLSVGHIKQIIGILRDFIRSPEHRVMATTISKLKVDLDFDSSSISQIHLVLFGFQDAVNKILRNHLIRPHWMFAMDNIIRRAVQAAVTILIPELRAHFEPTCETEGVDKDMDEAEEGYPPATGPGQEAQPHQQHLSLQLGELRQETNRLLEHLVEKEREYQNLLRQTLEQKTQELYHLQLKLKSNCITENPAGPYGQRTDKELIDWLRLQGADAKTIEKIVEEGYTLSDILNEITKEDLRYLRLRGGLLCRLWSAVSQYRRAQEASETKDKA

SEQ ID NO: 168 - protein, 1608 aa, Homo sapiens
MREAAAALVPPPAFAVTPAAAMEEPPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFSTRSMPSDARSHGSPAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 169 - protein, 894 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELPDSDGFLDSSEEIYYTARSNLDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 170 - protein, 360 aa, Homo sapiens [sequence omitted]

SEQ ID NO: 171 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 172 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 173 - protein, 795 aa, Homo sapiens
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRDPSEGEASGRTDTSRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 174 - protein, 800 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHSIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 175 - protein, 1914 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSASAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQVSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLWIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 176 - protein, 302 aa, Homo sapiens
MDEQSQGMQGPPVPQFQPQKALRPDMGYNTLANFRIEKKIGRGQFSEVYRAACLLDGVPVALKKVQIFDLMDAKARADCIKEIDLLKQLNHPNVIKYYASFIEDNELNIVLELADAGDLSRMIKHFKKQKRLIPERTVWKYFVQLCSALEHMHSRRVMHRDIKPANVFITATGVVKLGDLGLGRFFSSKTTAAHSLVGTPYYMSPERIHENGYNFKSDIWSLGCLLYEMAALQSPFYGDKMNLYSLCKKIEQCDYPPLPSDHYSEELRQLVNMCINPDPEKRPDVTYVYDVAKRMHACTASS

SEQ ID NO: 177 - protein, 979 aa, Homo sapiens
MSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCGDEFTIAATDDNHIFAWGNGGNGRLAMTPTERPHGSDICTSWPRPIFGSLHHVPDLSCRGWHTILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 178 - protein, 535 aa, Homo sapiens
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 179 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 180 - protein, 527 aa, Homo sapiens
MSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 181 - protein, 545 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTLNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALESLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHQFLKIAKPLSSLTPLIAAAKEATKNNH

SEQ ID NO: 182 - protein, 540 aa, Homo sapiens [sequence omitted]

SEQ ID NO: 183 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 184 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 185 - protein, 984 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 186 - protein, 559 aa, Homo sapiens
MRRLSSWRKMATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 187 - protein, 351 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 188 - protein, 351 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 189 - protein, 331 aa, Homo sapiens
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 190 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 191 - protein, 596 aa, Homo sapiens
MPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 192 - protein, 878 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDVRWEQFAAEHPLPGSGLPTDRDLGGACPPQDHDMQGLAERISVL

SEQ ID NO: 193 - protein, 4128 aa, Homo sapiens [sequence omitted]

SEQ ID NO: 194 - protein, 1007 aa, Homo sapiens
MAAAETQSLREQPEMEDANSEKSINEENGEVSEDQSQNKHSRHKKKKHKHRSKHKKHKHSSEEDKDKKHKHKHKHKKHKRKEIIDASDKEGMSPAKRTKLDDLALLEDLEKQRALIKAELDNELMEGKVQSGMGLILQGYESGSEEEGEIHEKARNGNRSSTRSSSTKGKLELVDNKITTKKRSKSRSKERTRHRSDKKKSKGGIEIVKEKTTRSKSKERKKSKSPSKRSKSQDQARKSKSPTLRRRSQEKIGKARSPTDDKVKIEDKSKSKDRKKSPIINESRSRDRGKKSRSPVDLRGKSKDRRSRSKERKSKRSETDKEKKPIKSPSKDASSGKENRSPSRRPGRSPKRRSLSPKPRDKSRRSRSPLLNDRRSKQSKSPSRTLSPGRRAKSRSLERKRREPERRRLSSPRTRPRDDILSRRERSKDASPINRWSPTRRRSRSPIRRRSRSPLRRSRSPRRRSRSPRRRDRGRRSRSRLRRRSRSRGGRRRRSRSKVKEDKFKGSLSEGMKVEQESSSDDNLEDFDVEEEDEEALIEQRRIQRQAIVQKYKYLAEDSNMSVPSEPSSPQSSTRTRSPSPDDILERVAADVKEYERENVDTFEASVKAKHNLMTVEQNNGSSQKKLLAPDMFTESDDMFAAYFDSARLRAAGIGKDFKENPNLRDNWTDAEGYYRVNIGEVLDKRYNVYGYTGQGVFSNVVRARDNARANQEVAVKIIRNNELMQKTGLKELEFLKKLNDADPDDKFHCLRLFRHFYHKQHLCLVFEPLSMNLREVLKKYGKDVGLHIKAVRSYSQQLFLALKLLKRCNILHADIKPDNILVNESKTILKLCDFGSASHVADNDITPYLVSRFYRAPEIIIGKSYDYGIDMWSVGCTLYELYTGKILFPGKTNNHMLKLAMDLKGKMPNKMIRKGVFKDQHFDQNLNFMYIEVDKVTEREKVTVMSTINPTKDLLADLIGCQRLPEDQRKKVHQLKDLLDQILMLDPAKRISINQALQHAFIQEKI

SEQ ID NO: 195 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 196 - protein, 552 aa, Homo sapiens
MGKVNVAKLRYMSRDDFRVLTAVEMGMKNHEIVPGSLIASIASLKHGGCNKVLRELVKHKLIAWERTKTVQGYRLTNAGYDYLALKTLSSRQVVESVGNQMGVGKESDIYIVANEEGQQFALKLHRLGRTSFRNLKNKRDYHKHRHNVSWLYLSRLSAMKEFAYMKALYERKFPVPKPIDYNRHAVVMELINGYPLCQIHHVEDPASVYDEAMELIVKLANHGLIHGDFNEFNLILDESDHITMIDFPQMVSTSHPNAEWYFDRDVKCIKDFFMKRFSYESELFPTFKDIRREDTLDVEVSASGYTKEMQADDELLHPLGPDDKNIETKEGSEFSFSDGEVAEKAEVYGSENESERNCLEESEGCYCRSSGDPEQIKEDSLSEESADARSFEMTEFNQALEEIKGQVVENNSVTEFSEEKNRTENYNRQDGQRVQGGVPAGSDEYEDECPHLIALSSLNREFRPFRDEENVGAMNQYRTRTLSITSSGSAVSCSTIPPELVKQKVKRQLTKQQKSAVRRRLQKGEANIFTKQRRENMQNIKSSLEAASFWGE

SEQ ID NO: 197 - protein, 671 aa, Homo sapiens
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 198 - protein, 1354 aa, Homo sapiens
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 199 - protein, 1388 aa, Homo sapiens
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 200 - protein, 735 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 201 - protein, 802 aa, Homo sapiens
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 202 - protein, 525 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 203 - protein, 808 aa, Homo sapiens
MWFFARDPVRDFPFELIPEPPEGGLPGPWALHRGRKKATGSPVSIFVYDVKPGAEEQTQVAKAAFKRFKTLRHPNILAYIDGLETEKCLHVVTEAVTPLGIYLKARVEAGGLKELEISWGLHQIVKALSFLVNDCSLIHNNVCMAAVFVDRAGEWKLGGLDYMYSAQGNGGGPPRKGIPELEQYDPPELADSSGRVVREKWSADMWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGVPAPAPTPVPATPTTSGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 204 - protein, 1235 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEVINEVEKAPKELRKELMKRRKEELAQSQHAQEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 205 - protein, 655 aa, Homo sapiens
MERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 206 - protein, 699 aa, Homo sapiens
MSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 207 - protein, 968 aa, Homo sapiens
MAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 208 - protein, 443 aa, Homo sapiens
MDSRAQLWGLALNKRRATLPHPGGSTNLKADPEELFTKLEKIGKGSFGEVFKGIDNRTQKVVAIKIIDLEEAEDEIEDIQQEITVLSQCDSPYVTKYYGSYLKDTKLWIIMEYLGGGSALDLLEPGPLDETQIATILREILKGLDYLHSEKKIHRDIKAANVLLSEHGEVKLADFGVAGQLTDTQIKRNTFVGTPFWMAPEVIKQSAYDSKADIWSLGITAIELARGEPPHSELHPMKVLFLIPKNNPPTLEGNYSKPLKEFVEACLNKEPSFRPTAKELLKHKFILRNAKKTSYLTELIDRYKRWKAEQSHDDSSSEDSDAETDGQASGGSDSGDWIFTIREKDPKNLENGALQPSDLDRNKMKDIPKRPFSQCLSTIISPLFAELKEKSQACGGNLGSIEELRGAIYLAEEACPGISDTMVAQLVQRLQRYSLSGGGTSSH

SEQ ID NO: 209 - protein, 491 aa, Homo sapiens
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 210 - protein, 465 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVATSNHPETDYKNKDWVFINYTYKRFEGLTARGAIPSYMKAAK

SEQ ID NO: 211 - protein, 545 aa, Homo sapiens
MAEPSGSPVHVQLPQQAAPVTAAAAAAPAAATAAPAPAAPAAPAPAPAPAAQAVGWPICRDAYELQEVIGSGATAVVQAALCKPRQERVAIKRINLEKCQTSMDELLKEIQAMSQCSHPNVVTYYTSFVVKDELWLVMKLLSGGSMLDIIKYIVNRGEHKNGVLEEAIIATILKEVLEGLDYLHRNGQIHRDLKAGNILLGEDGSVQIADFGVSAFLATGGDVTRNKVRKTFVGTPCWMAPEVMEQVRGYDFKADMWSFGITAIELATGAAPYHKYPPMKVLMLTLQNDPPTLETGVEDKEMMKKYGKSFRKLLSLCLQKDPSKRPTAAELLKCKFFQKAKNREYLIEKLLTRTPDIAQRAKKVRRVPGSSGHLHKTEDGDWEWSDDEMDEKSEEGKAAFSQEKSRRVKEENPEIAVSASTIPEQIQSLSVHDSQGPPNANEDYREASSCAVNLVLRLRNSRKELNDIRFEFTPGRDTADGVSQELFSAGLVDGHDVVIVAANLQKIVDDPKALKTLTFKLASGCDGSEIPDEVKLIGFAQLSVS

SEQ ID NO: 212 - protein, 635 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPATWSAGGIISRIKSYSFPKPGHRKSSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 213 - protein, 898 aa, Homo sapiens
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 214 - protein, 729 aa, Homo sapiens
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 215 - protein, 631 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 216 - protein, 400 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 217 - protein, 253 aa, Homo sapiens
MAAARATTPADGEEPAPEAEALAAARERSSRFLSGLELVKQGAEARVFRGRFQGRAAVIKHRFPKGYRHPALEARLGRRRTVQEARALLRCRRAGISAPVVFFVDYASNCLYMEEIEGSVTVRDYIQSTMETEKTPQGLSNLAKTIGQVLARMHDEDLIHGDLTTSNMLLKPPLEQLNIVLIDFGLSFISALPEDKGVDLYVLEKAFLSTHPNTETVFEAFLKSYSTSSKKARPVLKKLDEVRLRGRKRSMVG

SEQ ID NO: 218 - protein, 3097 aa, Homo sapiens
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 219 - protein, 34350 aa, Homo sapiens
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWRISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMRENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKARKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAQLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAISKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKGVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEIKKKVTEKKVVIPKKEEAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKVPEVLPPKEVVPEKKVPVPPAKKPEAPPPKVPEAPKEVVPEKKVPVPPPKKPEVPPTKVPEVPKAAVPEKKVPEAIPPKPESPPPEVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 220 - protein, 350 aa, Homo sapiens
MSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 221 - protein, 396 aa, Homo sapiens
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKEPGVEDTEWSNTQTEEAIQTRSRTRKRVQK

SEQ ID NO: 222 - protein, 2382 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 223 - protein, 543 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 224 - protein, 1531 aa, Homo sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 225 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 226 - protein, 318 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 227 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 228 - protein, 277 aa, Homo sapiens [sequence omitted]

SEQ ID NO: 229 - protein, 479 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 230 - protein, 198 aa, Homo Sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 231 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 232 - protein, 187 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 233 - protein, 637 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 234 - protein, 184 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 235 - protein, 203 aa, Homo sapiens
  MOD_RES (49)..(49): Selenocysteine
MCAARLAAAAAAAQSVYAFSARPLAGGEPVSLGSLRGKVLLIENVASLCGTTVRDYTQMNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 236 - protein, 210 aa, Homo sapiens
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 237 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 238 - protein, 209 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 239 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 240 - protein, 205 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 241 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 242 - protein, 963 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 243 - protein, 189 aa, Homo sapiens [sequence omitted]

SEQ ID NO: 244 - protein, 1152 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETITGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 245 - protein, 207 aa, Homo sapiens
MDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 246 - protein, 756 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 247 - protein, 934 aa, Homo sapiens [sequence omitted]

SEQ ID NO: 248 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 249 - protein, 310 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 250 - protein, 449 aa, Homo sapiens
MGRVGGMAQPMGRAGAPKPMGRAGSARRGRFKGCWSEGSPVHPVPAVLSWLLALLRCASTMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 251 - protein, 149 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKESKDPADETEAD

SEQ ID NO: 252 - protein, 765 aa, Homo sapiens
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 253 - protein, 1531 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 254 - protein, 1621 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 255 - protein, 444 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 256 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 257 - protein, 497 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 258 - protein, 7 aa, Mus musculus
  MOD_RES (4)..(4): PHOSPHORYLATION
DYDTLSK

SEQ ID NO: 259 - protein, 25 aa, Mus musculus
  MOD_RES (8)..(8): PHOSPHORYLATION
  MOD_RES (11)..(11): PHOSPHORYLATION
AGTTVPESIHSFIGDGLVKPEALNK

SEQ ID NO: 260 - protein, 18 aa, Mus musculus
  MOD_RES (1)..(1): PHOSPHORYLATION
SQSSGSSATHPISVPGAR

SEQ ID NO: 261 - protein, 19 aa, Mus musculus
  MOD_RES (3)..(3): PHOSPHORYLATION
TASEGDGGAAGGAGTAGGR

SEQ ID NO: 262 - protein, 9 aa, Mus musculus
  MOD_RES (3)..(3): PHOSPHORYLATION
TYSLTTPAR

SEQ ID NO: 263 - protein, 17 aa, Mus musculus
  MOD_RES (9)..(9): PHOSPHORYLATION
QVPQPSSASLDEYTLMR

SEQ ID NO: 264 - protein, 18 aa, Mus musculus
  MOD_RES (3)..(3): PHOSPHORYLATION
KTSDANETEDHLESLICK

SEQ ID NO: 265 - protein, 19 aa, Mus musculus
  MOD_RES (3)..(3): PHOSPHORYLATION
TWTLCGTPEYLAPEIILSK

SEQ ID NO: 266 - protein, 23 aa, Mus musculus
  MOD_RES (2)..(2): PHOSPHORYLATION
YSTPHAFTFNTSSPSSEGSLSQR

SEQ ID NO: 267 - protein, 14 aa, Mus musculus
  MOD_RES (2)..(2): PHOSPHORYLATION
HSPDTAEGQLKEDR

SEQ ID NO: 268 - protein, 10 aa, Mus musculus
  MOD_RES (3)..(3): PHOSPHORYLATION
RHSVTLPSSK

SEQ ID NO: 269 - protein, 8 aa, Mus musculus
  MOD_RES (3)..(3): PHOSPHORYLATION
SFSEGGER

SEQ ID NO: 270 - protein, 17 aa, Mus musculus
  MOD_RES (3)..(3): PHOSPHORYLATION
TASFSESRADEVAPAKK

SEQ ID NO: 271 - protein, 12 aa, Mus musculus
  MOD_RES (1)..(1): PHOSPHORYLATION
SLPVSVPVWAFK

SEQ ID NO: 272 - protein, 8 aa, Mus musculus
  MOD_RES (3)..(3): PHOSPHORYLATION
LNTSDFQK

SEQ ID NO: 273 - protein, 21 aa, Mus musculus
  MOD_RES (3)..(3): PHOSPHORYLATION
TTSFAESCKPVQQPSAFGSMK

SEQ ID NO: 274 - protein, 13 aa, Mus musculus
  MOD_RES (7)..(7): PHOSPHORYLATION
  MOD_RES (9)..(9): PHOSPHORYLATION
HTDDEMTGYVATR

SEQ ID NO: 275 - protein, 13 aa, Mus musculus
  MOD_RES (3)..(3): PHOSPHORYLATION
GDSVSDNGSEAVR

SEQ ID NO: 276 - protein, 10 aa, Mus musculus
  MOD_RES (4)..(4): PHOSPHORYLATION
RFVSEGDGGR

SEQ ID NO: 277 - protein, 13 aa, Mus musculus
  MOD_RES (2)..(2): PHOSPHORYLATION
NSFTPLSSSNTIR

SEQ ID NO: 278 - protein, 18 aa, Mus musculus
  MOD_RES (3)..(3): PHOSPHORYLATION
NYSVGSRPLKLKPLSPLR

The invention claimed is:

1. A method for quantifying one or a plurality of first biomolecules in a human sample, comprising:
    (a) extracting a plurality of second biomolecules comprising one or a plurality of reference biomolecules from a mixture of at least two different human cell populations, wherein said at least two different human cell populations are populations of cells from different human cell lines; wherein said one or said plurality of reference biomolecules are a metabolically isotope labeled form of said one or said plurality of first biomolecules, thereby obtaining a standard mixture;
    (b) mixing said standard mixture with said human sample;
    (c) determining the quantity of said one or said plurality of first biomolecules in said human sample; and
    (d) comparing the quantity determined in step (c) to the quantity of one or a plurality of reference biomolecules amongst a plurality of second biomolecules in said standard mixture,
    wherein said first and reference biomolecules are proteins or peptides, and wherein the quantity of said one or said plurality of first biomolecules and said one or said plurality of reference biomolecules is determined by mass spectrometry.

2. The method of claim 1, wherein said one or said plurality of reference biomolecules in said standard mixture are preselected, and the mass spectrometrical analysis is targeted to them by single or multiple ion monitoring.

3. The method of claim 2, wherein said comparing step comprises determining the ratio of intensities between a peak or the peaks of said one or said plurality of first biomolecules and a corresponding peak or the corresponding peaks of said one or said plurality of reference biomolecules.

4. The method of claim 2, wherein said at least two different human cell populations differ from each other in respect of cell morphology, expression profile of at least one biomolecule and/or state of differentiation.

5. The method of claim 2, wherein said human sample is whole tissue or selected parts of a tissue.

6. The method of claim 2, wherein the metabolic isotope labeling is stable isotope labeling with amino acids in cell culture (SILAC).

7. The method of claim 1, wherein said comparing step comprises determining the ratio of intensities between a peak or the peaks of said one or said plurality of first biomolecules and a corresponding peak or the corresponding peaks of said one or said plurality of reference biomolecules.

8. The method of claim 7, wherein said at least two different human cell populations differ from each other in respect of cell morphology, expression profile of at least one biomolecule and/or state of differentiation.

9. The method of claim 7, wherein said human sample is whole tissue or selected parts of a tissue.

10. The method of claim 7, wherein the metabolic isotope labeling is stable isotope labeling with amino acids in cell culture (SILAC).

11. The method of claim 1, wherein said at least two different human cell populations differ from each other in respect of cell morphology, expression profile of at least one biomolecule and/or state of differentiation.

12. The method of claim 11, wherein said human sample is whole tissue or selected parts of a tissue.

13. The method of claim 11, wherein the metabolic isotope labeling is stable isotope labeling with amino acids in cell culture (SILAC).

14. The method of claim 1, wherein said human sample is whole tissue or selected parts of a tissue.

15. The method of claim 14, wherein the metabolic isotope labeling is stable isotope labeling with amino acids in cell culture (SILAC).

16. The method of claim 1, wherein the metabolic isotope labeling is stable isotope labeling with amino acids in cell culture (SILAC).

17. A method for preparing a standard mixture for quantifying one or a plurality of first biomolecules in a human sample, comprising extracting a plurality of second biomolecules comprising one or a plurality of reference biomolecules from a mixture of at least two different human cell populations, wherein said at least two different human cell populations are populations of
 (i) cells of different cell types,
 (ii) cells from different cell lines;
 (iii) cells of different cell lineages; or
 (iv) cells from different cell cultures, wherein the cultures have been subjected to different culture conditions,
 wherein said one or said plurality of reference biomolecules are a metabolically isotope labeled form of said one or said plurality of first biomolecules, and wherein said biomolecules are proteins or peptides.

18. The method of claim 17, wherein said at least two different human cell populations differ from each other in respect of cell morphology, expression profile of at least one biomolecule and/or state of differentiation.

19. The method of claim 17, wherein said human sample is selected from the group of samples consisting of cells, such as tumor cells, for example blood associated tumor cells; whole tissue or selected parts of a tissue;
 healthy tissue; tissue associated with a disease, wherein said disease is chronic inflammation, metabolic disease, particularly diabetes, cardiovascular disease, tumor tissue, wherein said tumor tissue is breast cancer tissue, other carcinoma tissue, sarcoma tissue, neuroendocrine tumor tissue, blood associated tumor tissue, lymphoma tissue, and teratoma tissue;
 sub-cellular compartments of cells or tissue, e.g., mitochondria or cell nuclei;
 body fluids;
 extracts of the above; and
 selected protein fractions from the above, e.g., enriched membrane proteins, glycoproteins, phosphorylated proteins, acetylated proteins, ubiquitinated proteins, proteins with other modifications and protein complexes.

20. The method of claim 17, wherein the metabolic isotope labeling is stable isotope labeling with amino acids in cell culture (SILAC).

* * * * *